US007229784B2

(12) United States Patent
Holtzman et al.

(10) Patent No.: US 7,229,784 B2
(45) Date of Patent: Jun. 12, 2007

(54) MODULATION OF SECONDARY METABOLITE PRODUCTION BY ZINC BINUCLEAR CLUSTER PROTEINS

(75) Inventors: Douglas Holtzman, Jamaica Plain, MA (US); Kevin T. Madden, Charlestown, MA (US); Mary Maxon, San Francisco, CA (US); Amir Sherman, Jerusalem (IL)

(73) Assignee: Microbia, Inc., Cambridge, MA (US)

( * ) Notice: Subject to any disclaimer, the term of this patent is extended or adjusted under 35 U.S.C. 154(b) by 624 days.

(21) Appl. No.: 10/149,310

(22) PCT Filed: Sep. 19, 2001

(86) PCT No.: PCT/US01/29288

§ 371 (c)(1),
(2), (4) Date: Jun. 10, 2002

(87) PCT Pub. No.: WO02/24865

PCT Pub. Date: Mar. 28, 2002

(65) Prior Publication Data

US 2004/0077039 A1   Apr. 22, 2004

Related U.S. Application Data

(60) Provisional application No. 60/233,564, filed on Sep. 19, 2000.

(51) Int. Cl.
*C12P 1/02* (2006.01)
(52) U.S. Cl. .......................... 435/41; 435/43; 435/47; 435/67; 435/72
(58) Field of Classification Search ................. 435/41, 435/43, 47, 67, 72
See application file for complete search history.

(56) References Cited

U.S. PATENT DOCUMENTS

2002/0128250 A1* 9/2002 Busby et al. ............... 514/192

FOREIGN PATENT DOCUMENTS

| WO | WO 00/20596 | 4/2000 |
| WO | WO 00/37629 | 6/2000 |

OTHER PUBLICATIONS

Martegani et al. Yeast 9: 575-582, 1997.*
Katz et al. Isolation and Analysis of the Acetate Regulatory Gene, facB, from Aspergillus nidulans. Mol. Cell. Biol. 9:5696-5701 1989.*
Penalva et al., "The optimization of penicillin biosynthesis in fungi" Trends in Biotech. 16:483-489, 1998.
Suarez et al., "Characterization of a *Penicillium chrysogenum* gene encoding a PacC transcription factor and its . . . " Mol. Microbiol. 20:529-540, 1996.

Todd et al., "Evolution of a fungal regulatory gene family: The Zn(II)2Cys6 binuclear cluster DNA binding motif" Fungal Genet. and Biol. 21:388-405, 1997.
Van Peij et al., "Isolation and analysis of xInR, encoding a transcriptional activator co-ordinating xylanolytic . . . " Mol. Microb. 27:131-142, 1998.
Wang et al., "Yeast transcriptional regulator Leu3p" J. of Biol. Chem. 274:19017-19024, 1999.
Zhou et al., "Yeast regulatory protein LEU3: a structure-function analysis" Nucl. Acids Res. 18:291-298, 1990.
Carvajal et al., "Molecular and phenotypic characterization of yeast PDR1 mutants that show . . . " Mol. Gen. Genet. 256:406-415, 1997.
Casqueiro et al., "Gene targeting in *Penicillium chrysogenum*: Disruption of the *lys2* gene . . . " J. of Bacteriol. 181:1181-1188, 1999.
Chang et al., "Increased expression of *Aspergillus parasiticus aflR*, encoding a sequence-specific DNA-binding protein . . . " Applied and Env. Microbiol. 61:2372-2377, 1995.
Crowley et al., "A mutation in a purported regulatory gene affects control of sterol uptake . . . " J. of Bacteriol. 180:4177-4183, 1998.
D'Alessio et al., "Cross-pathway regulation in *Saccharomyces cerevisiae*: Activation of the proline utilization . . . " J. of Bacteriol. 182:3748-3753, 2000.
Dickson et al., "Genetic evidence for similar negative regulatory domains in the yeast transcription . . . " Nucl. Acids. Res. 18:5213-5217, 1990.
Friden et al., "A large internal deletion converts yeast LEU3 to a constitutive transcriptional activator" Mol. and Cel. Biol. 9:4056-4060, 1989.
Haas et al., "NRE, the major nitrogen regulatory protein of *Penicillium chrysogenum*, binds specifically to elements in the . . . " Curr. Genet. 28:177-183, 1995.
Hasper et al., "The *Aspergillus niger* transcriptional activator XinR, which is involved in . . . " Mol. Microbiol. 36:193-200, 2000.
Marczak et al., "Analysis of constitutive and noninducible mutations of the PUT3 transcriptional activator" Mol. and Cell. Biol. 11:2609-2619, 1991.
Mingot et al., "Disruption of *phacA*, an *Aspergillus nidulans* gene encoding a novel cytochrome P450 monooxygenase . . . " J. of Biol. Chem. 274:14545-14550, 1999.
Nourani et al., "Clustered amino acid substitutions in the yeast transcription regulator Pdr3p increase pleiotropic . . . " Mol. Gen. Genet. 256:397-405, 1997.
Oestreicher et al., "A single amino acid change in a pathway-specific transcription factor results in differing . . . " J. Mol. Biol. 249:693-699, 1995.
Ehrlich et al., "Alteration of Different Domains in AFLR Affects Aflatoxin Pathway Metabolism in *Aspergillus parasiticus* Transformants" Fungal Gen. And Biol. 23:279-287, 1998.

* cited by examiner

*Primary Examiner*—David Guzo
*Assistant Examiner*—David Lambertson
(74) *Attorney, Agent, or Firm*—Fish & Richardson P.C.

(57) ABSTRACT

Methods for improving the production of a secondary metabolite by a fungus by increasing the yield or productivity of the secondary metabolite produced by the fungus are described. The methods include increasing the expression of LYS14, for example, by transforming a cell with a nucleic acid molecule encoding LYS14.

42 Claims, No Drawings

MODULATION OF SECONDARY METABOLITE PRODUCTION BY ZINC BINUCLEAR CLUSTER PROTEINS

This application claims priority from PCT/US01/29288, filed Sep. 19, 2001, which in turn claims priority from U.S. Provisional Application 60/233,564, filed Sep. 19, 2000, the contents of which are hereby incorporated by reference.

BACKGROUND OF THE INVENTION

1. Field of the Invention

The invention relates to secondary metabolite production by fungi. More particularly, the invention relates to modulation of secondary metabolite production by fungi through genetic manipulation of such fungi.

2. Description of the Related Art

Secondary metabolite production by various fungi has been an extremely important source of a variety of therapeutically significant pharmaceuticals. β-lactam antibacterials such as penicillin and cephalosporin are produced by *Penicillium chrysogenum* and *Acremonium cirysogenum*, respectively, and these compounds are by far the most frequently used antibacterials (reviewed in Luengo and Penalva (1994), *Prog. Ind. Microbiol.* 29: 603–38; Jensen and Demain (1995), *Biotechnology* 28: 239–68; Brakhage (1998), *Microbiol. Mol. Biol.* Rev. 62: 547–85). Cyclosporin A, a member of a class of cyclic undecapeptides, is produced by *Tolypocladium inflatum*. Cyclosporin A dramatically reduces morbidity and increases survival rates in transplant patients (Borel (1986), *Prog. Allergy* 38: 9–18). In addition, several fungal secondary metabolites are cholesterol lowering drugs, including lovastatin, which is made by *Aspergillus terreus* and several other fungi (Alberts et al. (1980), *Proc. Natl. Acad. Sci. USA* 77: 3957–3961). These and many other fungal secondary metabolites have contributed greatly to health care throughout the world (see Demain (1992), *Ciba Found. Symp.* 171: 3–16; Bentley (1991), *Crit. Rev. Biotechnol.* 19: 1–40).

Unfortunately, many challenges are encountered between the detection of a secondary metabolite activity to production of significant quantities of pure drug. Thus, efforts have been made to improve the production of secondary metabolites by fungi. Some of these efforts have attempted to improve production by modification of the growth medium or the bioreactor used to carry out the fermentation. Buckland et al. (1989), in *Topics in Industrial Microbiology: Novel Microbial Products for Medicine and Agriculture*, Elsevier, Amsterdam, pp. 161–169, discloses improved lovastatin production by modification of carbon source and also teaches the superiority of a hydrofoil axialflow impeller in the bioreactor. Other efforts have involved strain improvements, either through re-isolation or random mutagenesis. Agathos et al. (1986), *J. Ind. Microbiol.* 1: 39–48, teaches that strain improvement and process development together resulted in a ten-fold increase in cyclosporin A production. While important, studies of these types have still left much room for improvement in the production of secondary metabolites.

More recently, strains have been improved by manipulation of the genes encoding the biosynthetic enzymes that catalyze the reactions required for production of secondary metabolites. Penalva et al. (1998), *Trends Biotechnol.* 16: 483–489 discloses that production strains of *P. chrysogenum* have increased copy number of the penicillin synthesis structural genes. Other studies have modulated expression of other biosynthetic enzyme-encoding genes, thereby affecting overall metabolism in the fungus. Mingo et al. (1999), *J. Biol. Chem.* 21: 14545–14550, demonstrate that disruption of phacA, an enzyme in *A. nidulans* that catalyzes phenylacetate 2-hydroxylation, leads to increased penicillin production, probably by elimination of competition for the substrate phenylacetate. Similarly, disruption of the gene encoding aminoadipate reductase in *P. chrysogenum* increased penicillin production, presumably by eliminating competition for the substrate alpha-aminoadipate (Casquiero et al. (1999), *J. Bacteriol.* 181: 1181–1188).

Thus, genetic manipulation holds promise for improving production of secondary metabolites. Genetic manipulation to increase the activity of biosynthetic enzymes for secondary metabolite production or to decrease the activity of competing biosynthetic pathways has proven effective for improving production. Maximum benefit can be achieved by combining several strategies of manipulation. For example, modulating the expression of genes that regulate the biosynthetic enzyme-encoding genes can improve production. In addition, genetic manipulation can be used to impact upon the challenges that are encountered in the fermentor run or downstream processing (e.g., energy cost, specific production of desired metabolite, maximal recovery of metabolite, cost of processing waste from fermentations). There is, therefore, a need for methods for improving secondary metabolite production in a fungus, comprising modulating the expression of a gene involved in regulation of secondary metabolite production in fungi.

One challenge is to identify the types of genes that would be useful for such modulation. Todd and Andrianopoulos (1997), *Fungal Genetics and Biology* 21: 388–405, teaches that Zn(II)2Cys6 proteins (zinc binuclear cluster proteins, or "ZBC proteins") are involved in a wide range of processes, including primary and secondary metabolism. This reference teaches that such proteins are primarily, though not exclusively, transcriptional activators. Chang et al. (1995), *Applied Environ. Microbiol.* 61: 2372–2377, teaches that increased expression of aflR, a ZBC protein, relieves nitrate inhibition of aflatoxin biosynthesis in *Aspergillus parasiticus*. PCT Publication WO 00/37629, teaches that overexpressing lovE, another ZBC protein, increases lovastatin production in *Aspergillus terreus*. Noel et al (1998), *Mol. Microbiol.* 27: 131–142, teaches that xlnR, a ZBC protein, induces expression of xylanolytic extracellular enzymes in *Aspergillus niger*. Hasper et al. (2000), *Mol. Microbiol.* 36: 193–200, teaches that xlnR also regulates D-xylose reductase gene expression in *Aspergillus niger*. D'Alessio and Brandriss (2000), *J. Bacteriology* 182: 3748–3753, discloses that Gal4p, a ZBC protein, can activate the PUT (proline utilization) genes in a *Saccharomyces cerevisiae* strain lacking the normal gene for regulation of this pathway, PUT3. PCT Publication WO 00/20596 discloses that prtT, a ZBC protein, activates extracellular proteases in *Aspergillus niger*.

Numerous studies have examined the effects of mutations in genes that encode ZBC proteins. Crowley et al (1998), *J. Bacteriol.* 180: 4177–4183, discloses that a single missense mutation in UPC2, a ZBC gene, results in pleiotropic effects in *Saccharomyces cerevisiae*. Friden et al. (1989), *Mol. Cell. Biol.* 9: 4056–4060, teaches that a large internal deletion in Leu3p, a ZBC protein, in *Sacclzaromyces cerevisiae* causes the protein to be a constitutive transcriptional activator. Oestreicher and Scazzocchio (1995), *J. MoL Biol.* 249: 693–699, discloses that a single amino acid change in Yc462, a ZBC protein, leads to constitutive, hyperinducible and derepressed expression of at least three genes in *Aspergillus nidulans*. Wang et al. (1999), *J. Biol. Chem.* 274:

19017–19024, discloses that nine distinct missense mutations in LEU3 affect the masking of the activation domain of that ZBC protein. Dickson et al. (1990), *Nucleic Acids Res.* 18: 5213–5217, discloses that single amino acid changes in the C terminal region of Gal4p and Lac9p, two ZBC proteins, lead to constitutive expression of target genes. Marczak and Brandriss (1991), *MoL CelL Biol.* 11: 2609–2619, teaches that single point mutations in PUT3, a ZBC gene from *Saccharomyces cerevisiae*, lead to either constitutive or uninducible expression of proline utilization genes. Carvajal et al. (1997), *Mol. Gen. Genet.* 256: 406–415, teaches that single amino acid substitutions in Pdr1p, a ZBC protein from *Saccharomyces cerevisiae*, are responsible for over-expression of three transporter genes associated with multiple drug resistance. Nourani et al. (1997), *Mol. Gen. Genet.* 256: 397–405, teaches that substitutions in a conserved region of Pdr3p, a ZBC protein from *Saccharomyces cerevisiae*, leads to gain of function mutations. Zhou et al. (1990), *Nucleic Acids Res.* 18: 291–298, discloses that deletion of all or part of the linker region of Leu3p results in unmodulated activation of Leu3p target genes. Herlich et al. (1998), *Fungal Genetics Biol.* 23: 1807–1845, teaches that deletion of three amino acids in the C terminus of AflR results in increased expression of the aflatoxin pathway.

These studies demonstrate that ZBC genes can be manipulated in beneficial ways and may have promise as regulators of secondary metabolism. Unfortunately, no one has been able to create a commercial process in which production of a useful secondary metabolite has been significantly increased through the action of a ZBC protein. There is, therefore, a need for new commercial processes using ZBC proteins, or variants thereof, to significantly increase useful secondary metabolite production.

SUMMARY OF THE INVENTION

The invention relates to secondary metabolite production by fungi. More particularly, the invention relates to modulation of secondary metabolite production by fungi through genetic manipulation of such fungi. The invention provides new commercial processes using ZBC proteins, or variants thereof, to significantly improve the production of useful secondary metabolites. Generally, the methods according to the invention comprise expressing in a fungus a ZBC protein or a variant thereof.

In a first aspect, the invention provides methods for improving production of a secondary metabolite by a fungus by increasing the yield of the secondary metabolite produced by the fungus. The methods according to this aspect of the invention comprise modulating the expression of a ZBC gene or gene variant in a manner that improves the yield of the secondary metabolite.

In a second aspect, the invention provides methods for improving production of a secondary metabolite by a fungus by increasing productivity of the secondary metabolite in the fungus, the methods comprising modulating the expression of a ZBC gene or gene variant in a manner that improves the productivity of the secondary metabolite.

In a third aspect, the invention provides methods for improving production of a secondary metabolite in a fungus by increasing efflux or excretion of the secondary metabolite, the method comprising modulating the expression of a ZBC gene or gene variant in a manner that increases efflux or excretion of the secondary metabolite.

In a fourth aspect, the invention provides methods for improving production of a secondary metabolite in a fungus by decreasing production of side products or non-desired secondary metabolites, the method comprising modulating the expression of a ZBC gene or gene variant in a manner that decreases production of side products or non-desired secondary metabolites.

In a fifth aspect, the invention provides methods for improving production of a secondary metabolite in a fungus by altering the characteristics of the fungus in a manner that is beneficial to the production of the secondary metabolite, the method comprising modulating the expression of a ZBC gene or gene variant in a manner that alters the characteristics of the fungus.

In a sixth aspect, the invention provides methods for improving production of a secondary metabolite in a fungus by causing conditional lysis of the fungus, the method comprising modulating the expression of a ZBC gene or gene variant in a manner that causes conditional lysis.

In a seventh aspect, the invention provides methods for improving production of a secondary metabolite in a fungus by increasing the resistance of the fungus to the deleterious effects of exposure to a secondary metabolite made by the same organism, the method comprising modulating the expression of a ZBC gene or gene variant in a manner that increases resistance to the deleterious effects of exposure to a secondary metabolite.

In an eighth aspect, the invention provides methods for improving production of a secondary metabolite in a fungus by modulating the expression of one or more genes, the method comprising modulating the expression of a ZBC gene or gene variant that does not normally modulate the expression of such gene or genes.

In a ninth aspect, the invention provides genetically modified fungi, wherein the genetically modified fungi have an ability to produce secondary metabolites and the ability of the genetically modified fungus to produce secondary metabolites has been improved by any of the methods according to the invention.

In a tenth aspect, the invention provides a method for making a secondary metabolite, the method comprising culturing a genetically modified fungus according to the invention under conditions suitable for the production of secondary metabolites.

DETAILED DESCRIPTION

The invention relates to secondary metabolite production by fungi. More particularly, the invention relates to modulation of secondary metabolite production by fungi through genetic manipulation of such fungi. All issued patents, published and pending patent applications, and other references cited herein reflect the level of knowledge in this field and are hereby incorporated by reference in their entirety. In case of any conflict between the teachings of a cited reference and this specification, the latter shall prevail.

The invention provides new commercial processes using ZBC proteins, or variants thereof, to significantly increase useful secondary metabolite production. Generally, the methods according to the invention comprise expressing in a fungus a ZBC protein or a variant thereof. All aspects of the invention contemplate the modulation of one or more ZBC genes in a fungal cell of interest.

In a first aspect, the invention provides methods for improving production of a secondary metabolite by a fungus by increasing the yield of the secondary metabolite produced by the fungus. The methods according to this aspect of the invention comprise modulating the expression of a ZBC gene or gene variant in a manner that improves the yield of the secondary metabolite.

As used for all aspects of the invention, the term "improving production of a secondary metabolite" means positively impacting one or more of the variables that affect the process of production of secondary metabolites in a fungal fermentation. These variables include, without limitation, the amount of secondary metabolite being produced, the volume required for production of sufficient quantities, the cost of raw materials and energy, the time of fermentor run, the amount of waste that must be processed after a fermentor run, the specific production of the desired metabolite, the percent of produced secondary metabolite that can be recovered from the fermentation broth, and the resistance of an organism producing a secondary metabolite to possible deleterious effects of contact with the secondary metabolite. Also for all aspects, the term "secondary metabolite" means a compound, derived from primary metabolites, that is produced by an organism, is not a primary metabolite, is not ethanol or a fusel alcohol, and is not required for growth under standard conditions. Secondary metabolites are derived from intermediates of many pathways of primary metabolism. These pathways include, without limitation, pathways for biosynthesis of amino acids, the shikimic acid pathway for biosynthesis of aromatic amino acids, the polyketide biosynthetic pathway from acetyl coenzyme A (CoA), the mevalonic acid pathway from acetyl CoA, and pathways for biosynthesis of polysaccharides and peptidopolysaccharides. Secondary metabolism involves all primary pathways of carbon metabolism (*Fungal Physiology*, Chapter 9, pp 246–274, Griffin (ed.), John Wiley & Sons, Inc., New York, (1994)). "Secondary metabolites" also include intermediate compounds in the biosynthetic pathway for a secondary metabolite that are dedicated to the pathway for synthesis of the secondary metabolite. "Dedicated to the pathway for synthesis of the secondary metabolite" means that once the intermediate is synthesized by the cell, the cell will not convert the intermediate to a primary metabolite. "Intermediate compounds" also include secondary metabolite intermediate compounds which can be converted to useful compounds by subsequent chemical conversion or subsequent biotransformation. Nevertheless, providing improved availability of such intermediate compounds still leads to improved production of the ultimate useful compound, which itself may be referred to herein as a secondary metabolite. The yeast *Saccharomyces cerevisiae* is not known to produce secondary metabolites. The term "primary metabolite" means a natural product that has an obvious role in the functioning of the relevant organism. Primary metabolites include, without limitation, compounds involved in the biosynthesis of lipids, carbohydrates, proteins, and nucleic acids. The term "increasing the yield of the secondary metabolite" means increasing the quantity of the secondary metabolite present in the fermentation broth per unit volume of fermentation broth.

The term "ZBC gene" means any gene encoding a protein having as part of its structure Cys-(Xaa)$_2$-Cys-(Xaa)$_6$-Cys-(Xaa)$_{5-16}$-Cys-(Xaa)$_2$-Cys-(Xaa)$_{6-8}$-Cys (see e.g., Todd and Andrianopoulos (1997), *Fungal Genetics and Biology* 21: 388–405), wherein Xaa is any amino acid, each of which can be the same or different. Preferred ZBC genes according to this aspect of the invention include, without limitation, those genes identified in Table 1, below, and any fungal homologs thereof.

TABLE 1

Examples of preferred ZBC genes

| Name | Length (aa) | Size (bp) | Organism | SEQ ID NO |
|---|---|---|---|---|
| AAB05250_Hh | 455 | 1365 | *Fusarium solani* | 13 |
| AAC98670_Ca | 517 | 1551 | *Candida albicans* | 15 |
| AC15_Nc | 865 | 2595 | *Neurospora crassa* | 17 |
| acr2_Nc | 595 | 1785 | *Neurospora crassa* | 19 |
| AF168613_4_Ap | 491 | 1473 | *Aspergillus parasiticus* | 21 |
| AF230811_1_Pg | 974 | 2922 | *Pyricularia grisea* | 23 |
| aflR_Af | 437 | 1311 | *Aspergillus flavus* | 25 |
| AFLR_An | 433 | 1299 | *Aspergillus nidulans* | 27 |
| aflR_Ao | 384 | 1152 | *Aspergillus oryzae* | 29 |
| aflR_Ap | 444 | 1332 | *Aspergillus parasiticus* | 31 |
| alcR_An | 821 | 2463 | *Aspergillus nidulans* | 33 |
| AmdR-An | 765 | 2295 | *Aspergillus nidulans* | 35 |
| AmdR-Ao | 735 | 2205 | *Aspergillus oryzae* | 37 |
| AmyR-Anig | 579 | 1737 | *Aspergillus niger* | 39 |
| amyRAn | 662 | 1986 | *Aspergillus nidulans* | 41 |
| amyRAo | 604 | 1812 | *Aspergillus oryzae* | 43 |
| An13_An | 311 | 933 | *Aspergillus nidulans* | 45 |
| ARG81_YEAST | 880 | 2640 | *Saccharomyces cerevisiae* | 47 |
| ARGRII_YEAST | 879 | 2637 | *Saccharomyces cerevisiae* | 49 |
| At18_At | 397 | 1191 | *Aspergillus terreus* | 51 |
| BAA21449_Sp | 738 | 2214 | *Schizosaccharomyces pombe* | 53 |
| BAA87112_Sp | 71 | 212 | *Schizosaccharomyces pombe* | 55 |
| BAA87304_Sp | 188 | 564 | *Schizosaccharomyces pombe* | 57 |
| C23783_Pa | 412 | 1236 | *Pichia anomala* | 59 |
| CAA11231_Pa | 529 | 1587 | *Pichia anomala* | 61 |
| CAA18305_Sp | 867 | 2601 | *Schizosaccharomyces pombe* | 63 |
| CAA18884_Sp | 397 | 1191 | *Schizosaccharomyces pombe* | 65 |
| CAA19035_Sp | 827 | 2481 | *Schizosaccharomyces pombe* | 67 |
| CAA19036_Sp | 560 | 1680 | *Schizosaccharomyces pombe* | 69 |
| CAA19070_Sp | 525 | 1575 | *Schizosaccharomyces pombe* | 71 |
| CAA19171_Sp | 743 | 2229 | *Schizosaccharomyces pombe* | 73 |
| CAA 19174_Sp | 815 | 2445 | *Schizosaccharomyces pombe* | 75 |
| CAA20477_Sp | 547 | 1641 | *Schizosaccharomyces pombe* | 77 |
| CAA21815_Sp | 857 | 2571 | *Schizosaccharomyces pombe* | 79 |
| CAA21917_Sp | 594 | 1782 | *Schizosaccharomyces pombe* | 81 |
| CAA21921_Sp | 595 | 1785 | *Schizosaccharomyces pombe* | 83 |
| CAA21933_Ca | 510 | 1530 | *Candida albicans* | 85 |
| CAA22445_Sp | 480 | 1440 | *Schizosaccharomyces pombe* | 87 |
| CAA22655_Sp | 767 | 2301 | *Schizosaccharomyces pombe* | 89 |
| CAA22853_Sp | 736 | 2208 | *Schizosaccharomyces pombe* | 91 |
| CAA92308_Sp | 603 | 1809 | *Schizosaccharomyces pombe* | 93 |
| CAB16735_Sp | 783 | 2349 | *Schizosaccharomyces pombe* | 95 |
| CAB52588_Sm | 689 | 2067 | *Sordaria macrospora* | 97 |
| CAB59617_Sp | 625 | 1875 | *Schizosaccharomyces pombe* | 99 |
| CAB61777_Sp | 654 | 1962 | *Schizosaccharomyces pombe* | 101 |

TABLE 1-continued

Examples of preferred ZBC genes

| Name | Length (aa) | Size (bp) | Organism | SEQ ID NO |
|---|---|---|---|---|
| CAB71797_Tolypoclad | 905 | 2715 | *Tolypocladium inflatum* | 103 |
| CAR80_YEAST | 836 | 2508 | *Saccharomyces cerevisiae* | 105 |
| CAT8_Ca | 1056 | 3168 | *Candida albicans* | 107 |
| CAT8_Kl | 1445 | 4335 | *Kluyveromyces lactis* | 109 |
| CAT8_YEAST | 1433 | 4299 | *Saccharomyces cerevisiae* | 111 |
| CEP3_YEAST | 608 | 1824 | *Saccharomyces cerevisiae* | 113 |
| CHA4_YEAST | 648 | 1944 | *Saccharomyces cerevisiae* | 115 |
| CMR1_Cl | 984 | 2952 | *Colletotrichum lagenarium* | 117 |
| CT1A_Fs | 909 | 2727 | *Haematonectria haematococca* | 119 |
| CT1B_Fs | 882 | 2646 | *Haematonectria haematococca* | 121 |
| CZF1_Ca | 388 | 1164 | *Candida albicans* | 123 |
| DAL81_YEAST | 970 | 2910 | *Saccharomyces cerevisiae* | 125 |
| ECM22_YEAST | 814 | 2442 | *Saccharomyces cerevisiae* | 127 |
| FacB_An | 867 | 2601 | *Aspergillus nidulans* | 129 |
| FacB_Anig | 862 | 2586 | *Aspergillus niger* | 131 |
| FacB_Ao | 859 | 2577 | *Aspergillus oryzae* | 133 |
| FLUF_Nc | 792 | 2376 | *Neurospora crassa* | 135 |
| GAL4_YEAST | 881 | 2643 | *Saccharomyces cerevisiae* | 137 |
| HAL9_YEAST | 1030 | 3090 | *Saccharomyces cerevisiae* | 139 |
| HAP1_1483YEAST | 1483 | 4449 | *Saccharomyces cerevisiae* | 141 |
| HAP1_1502YEAST | 1502 | 4506 | *Saccharomyces cerevisiae* | 143 |
| LAC9_Kl | 865 | 2595 | *Kluyveromyces lactis* | 145 |
| lac9_Kmarx | 865 | 2595 | *Kluyveromyces marxianus var. lactis* | 147 |
| LEU3_YEAST | 886 | 2658 | *Saccharomyces cerevisiae* | 149 |
| lovE_At | 503 | 1509 | *Aspergillus terreus* | 151 |
| lovEv2_At | 469 | 1492 | *Aspergillus terreus* | 153 |
| lovU_At | 742 | 2226 | *Aspergillus terreus* | 155 |
| LYS14_YEAST | 790 | 2370 | *Saccharomyces cerevisiae* | 157 |
| M81157_1_Spastor | 470 | 1410 | *Saccharomyces pastorianus* | 159 |
| MAL13_YEAST | 473 | 1419 | *Saccharomyces cerevisiae* | 161 |
| MAL23_YEAST | 470 | 1410 | *Saccharomyces cerevisiae* | 163 |
| MAL33_YEAST | 468 | 1404 | *Saccharomyces cerevisiae* | 165 |
| MAL63_YEAST | 470 | 1410 | *Saccharomyces cerevisiae* | 167 |
| MAL6_Scarlsberg | 473 | 1419 | *Saccharomyces carlsbergensis* | 169 |
| MSP8_YEAST | 1429 | 4287 | *Saccharomyces cerevisiae* | 171 |
| NIRA_An | 892 | 2676 | *Aspergillus nidulans* | 173 |
| NIT4_Nc | 1090 | 3270 | *Neurospora crassa* | 175 |
| ntfl/thi1_Sp | 775 | 2325 | *Schizosaccharomyces pombe* | 177 |
| OAF1_YEAST | 1062 | 3186 | *Saccharomyces cerevisiae* | 179 |
| PDR3_YEAST | 976 | 2928 | *Saccharomyces cerevisiae* | 181 |
| PIP2_YEAST | 996 | 2988 | *Saccharomyces cerevisiae* | 183 |
| PPR1_YEAST | 904 | 2712 | *Saccharomyces cerevisiae* | 185 |
| PRIB_Le | 565 | 1695 | *Shiitake mushroom* | 187 |
| prnA_An | 818 | 2454 | *Aspergillus nidulans* | 189 |
| PUT3_YEAST | 979 | 2937 | *Saccharomyces cerevisiae* | 191 |
| QA1F_Nc | 816 | 2448 | *Neurospora crassa* | 193 |
| QUTA_An | 825 | 2475 | *Aspergillus nidulans* | 195 |
| RGT1_YEAST | 1170 | 3510 | *Saccharomyces cerevisiae* | 197 |
| SEF1_Kl | 1071 | 3213 | *Kluyveromyces lactis* | 199 |
| SEF1_YEAST | 1057 | 3171 | *Saccharomyces cerevisiae* | 201 |
| SIP4_YEAST | 829 | 2487 | *Saccharomyces cerevisiae* | 203 |
| STB4_YEAST | 949 | 2847 | *Saccharomyces cerevisiae* | 205 |
| STB5_YEAST | 743 | 2229 | *Saccharomyces cerevisiae* | 207 |
| SUC1_Ca | 501 | 1503 | *Candida albicans* | 209 |
| SUT1_YEAST | 299 | 897 | *Saccharomyces cerevisiae* | 211 |
| TamA_An | 739 | 2217 | *Aspergillus nidulans* | 213 |
| TBS1_YEAST | 1094 | 3282 | *Saccharomyces cerevisiae* | 215 |
| TEA1_YEAST | 759 | 2277 | *Saccharomyces cerevisiae* | 217 |
| THI2_YEAST | 450 | 1350 | *Saccharomyces cerevisiae* | 219 |
| UAY_An | 1060 | 3180 | *Aspergillus nidulans* | 221 |
| UGA3_YEAST | 528 | 1584 | *Saccharomyces cerevisiae* | 223 |
| xlnR_Anig | 875 | 2625 | *Aspergillus niger* | 225 |
| YAKB_Sp | 782 | 2346 | *Schizosaccharomyces pombe* | 227 |
| YAO7_Sp | 637 | 1911 | *Schizosaccharomyces pombe* | 229 |
| YAOC_Sp | 357 | 1071 | *Schizosaccharomyces pombe* | 231 |
| YAOClong_Sp | 644 | 1932 | *Schizosaccharomyces pombe* | 233 |
| YAS8_Sp | 563 | 1689 | *Schizosaccharomyces pombe* | 235 |
| YBR033W_YEAST | 919 | 2757 | *Saccharomyces cerevisiae* | 237 |
| YBR239C_YEAST | 529 | 1587 | *Saccharomyces cerevisiae* | 239 |
| YCR106W_YEAST | 832 | 2496 | *Saccharomyces cerevisiae* | 241 |
| YDR213W_YEAST | 913 | 2739 | *Saccharomyces cerevisiae* | 243 |
| YDR303C_YEAST | 885 | 2655 | *Saccharomyces cerevisiae* | 245 |
| YDR421W_YEAST | 950 | 2850 | *Saccharomyces cerevisiae* | 247 |
| YDR520C_YEAST | 772 | 2316 | *Saccharomyces cerevisiae* | 249 |
| YER184C_YEAST | 794 | 2382 | *Saccharomyces cerevisiae* | 251 |
| YFL052W_YEAST | 465 | 1395 | *Saccharomyces cerevisiae* | 253 |
| YIL130W_YEAST | 964 | 2892 | *Saccharomyces cerevisiae* | 255 |
| YJL103C_YEAST | 618 | 1854 | *Saccharomyces cerevisiae* | 257 |
| YJL206C_YEAST | 758 | 2274 | *Saccharomyces cerevisiae* | 259 |
| YKL222C_YEAST | 705 | 2115 | *Saccharomyces cerevisiae* | 261 |
| YKR064W_YEAST | 863 | 2589 | *Saccharomyces cerevisiae* | 263 |
| YLL054C_YEAST | 769 | 2307 | *Saccharomyces cerevisiae* | 265 |
| YLR266C_YEAST | 701 | 2103 | *Saccharomyces cerevisiae* | 267 |
| YLR278C_YEAST | 1341 | 4023 | *Saccharomyces cerevisiae* | 269 |

TABLE 1-continued

Examples of preferred ZBC genes

| Name | Length (aa) | Size (bp) | Organism | SEQ ID NO |
|---|---|---|---|---|
| YML076C_YEAST | 944 | 2832 | Saccharomyces cerevisiae | 271 |
| YNR063W_YEAST | 607 | 1821 | Saccharomyces cerevisiae | 273 |
| YOR172W_YEAST | 786 | 2358 | Saccharomyces cerevisiae | 275 |
| YOR380W_YEAST | 546 | 1638 | Saccharomyces cerevisiae | 277 |
| YPL133C_YEAST | 446 | 1338 | Saccharomyces cerevisiae | 279 |
| YPR009W_YEAST | 268 | 804 | Saccharomyces cerevisiae | 281 |
| YPR196W_YEAST | 470 | 1410 | Saccharomyces cerevisiae | 283 |
| YRR1_YEAST | 810 | 2430 | Saccharomyces cerevisiae | 285 |
| ZNF1_Ca | 388 | 1164 | Candida albicans | 287 |
| CAB57441_Sp | 497 | 1491 | Schizosaccharomyces pombe | 289 |
| PDR1SGD_YEAST | 1068 | 3204 | Saccharomyces cerevisiae | 291 |
| PDR1_YEAST | 1063 | 3189 | Saccharomyces cerevisiae | 293 |
| YHL6_YEAST | 883 | 2649 | Saccharomyces cerevisiae | 295 |
| At233 | 309 | 927 | Aspergillus terreus | 297 |
| Pc1001 | 859 | 2577 | Penicillium chrysogenum | 299 |
| At274 | 424 | 1272 | Aspergillus terreus | 301 |
| At221 | 850 | 2550 | Aspergillus terreus | 303 |
| An1000 | 758 | 2274 | Aspergillus nidulans | 305 |
| At240 | 576 | 1728 | Aspergillus terreus | 307 |

A "fungal homolog" of a reference gene is a fungal gene encoding a product that is capable of performing at least a portion of the function of the product encoded by the reference gene, which is substantially identical to the reference gene, and/or which encodes a product which is substantially identical to the product encoded by the reference gene. "Substantially identical" means a polypeptide or nucleic acid exhibiting at least 25%, preferably 50%, more preferably 80%, and most preferably 90%, or even 95% identity to a reference amino acid sequence or nucleic acid sequence. For polypeptides, the length of comparison sequences is generally at least 16 amino acids, preferably at least 20 amino acids, more preferably at least 25 amino acids, and most preferably 35 amino acids or greater. For nucleic acids, the length of comparison sequences is generally at least 50 nucleotides, preferably at least 60 nucleotides, more preferably at least 75 nucleotides, and most preferably 110 nucleotides or greater. Sequence identity is typically measured using sequence analysis software (for example, the Sequence Analysis Software Package of the Genetics Computer Group, University of Wisconsin Biotechnology Center, 1710 University Avenue, Madison Wis. 53705; or the BLAST, BEAUTY, or PILEUP/PRETTYBOX programs). For determining percentages of identity, a gap existence penalty of 11 and a gap extension penalty of 1 may be employed in such programs. For determining sequence similarity, such software assigns degrees of homology to various substitutions, deletions, and/or other modifications. Conservative substitutions typically include substitutions within the following groups: glycine, alanine, valine, isoleucine, leucine; aspartic acid, glutamic acid; asparagine, glutamine; serine, threonine; lysine, arginine; and phenylalanine, tyrosine.

For this aspect of the invention, when the secondary metabolite is aflatoxin or sterigmatocystin, the ZBC gene is not the aflR gene from *Aspergillus* spp.; and when the secondary metabolite is lovastatin, the ZBC gene is not the *Aspergillus terreus* lovE gene.

The term "ZBC gene or gene variant" means any ZBC gene, or any useful mutant form of such gene. Many useful mutations of ZBC genes and/or proteins are contemplated by the present invention, including various dominant mutations. A "dominant mutation" is an allele of a gene that encodes a protein capable of changing the phenotype of an organism more than a non-mutated form of the gene. Preferred dominant mutations include dominant negative mutations, dominant positive mutations, and dominant neomorphic mutations. A "dominant negative mutation" is a dominant mutation that achieves its phenotypic effect by interfering with some function of the gene or gene product from which it was derived, or from a homolog thereof. A "dominant positive mutation" is a dominant mutation that achieves its phenotypic effect by activating some function of the gene or gene product from which it was derived, or from a homolog thereof. A "dominant neomorphic mutation" is a dominant mutation that achieves the phenotypic effect of providing a novel function to the gene or gene product from which it was derived, or from a homolog thereof. Preferred dominant mutations according to this aspect of the invention include:

(1) Mutations that result in increased or decreased stability of the transcript of a gene.

(2) Mutations that result in increased or decreased stability of the product of translation: For example, specific sequences near the amino terminus of a protein have been shown to cause increased or decreased protein stability. Similarly, sequences elsewhere in the protein, such as those required for ubiquitin-dependent degradation, can be mutated to increase the stability of a protein.

(3) Amino acid substitutions that mimic post-translational modifications: For example, phosphorylation has been demonstrated to positively or negatively regulate the activity of a variety of proteins, including transcription factors and kinases. Phosphorylation most commonly occurs on serine, threonine, and tyrosine residues; in some instances residues such as aspartate and histidine can be phosphorylated. Mutations that mimic constitutive dephosphorylation can be produced by mutating the coding sequence of the phosphorylated residue to the coding sequence of an amino acid that cannot be phosphorylated and does not have a negatively charged side chain (e.g., alanine). Alternatively, substitutions that result in changing serine, threonine, or tyrosine residues to charged amino acids such as glutamate or aspartate can result in an allele that mimics constitutive phosphorylation.

Proteolytic cleavage is another post-translational mechanism for regulating the activity of a protein. Mutations that result in truncation of a protein can mimic activation by proteolysis. Mutations that change amino acids required for proteolysis can activate proteins that are negatively regulated by proteolysis.

(4) Amino acid substitutions that promote or inhibit the binding of small molecules such as ATP, cAMP, GTP or GDP: For example, Nucleotides are co-factors for many enzymes, and the nucleotide-binding domains of such proteins are highly conserved. Lysine to arginine substitutions in the nucleotide binding domain frequently result in the inhibition of enzymatic activity. Enzymatically inactive proteins can be dominant inactive molecules, acting by sequestering substrates from functional enzymes.

(5) Mutations in portions of genes that encode regulatory domains of proteins: For example, many proteins, including kinases, contain regulatory domains that function as mechanisms to control the timing of activation. Mutations in these domains might result in constitutive activation. Regulatory domains include linker regions and C terminal regions in the case of some ZBC proteins.

(6) Mutations that create a new protein function: For example, a mutation in a ZBC protein could result in altered DNA recognition specificity, such that the mutated ZBC protein can modulate the activity of pathways that it does not usually regulate.

(7) Fusion of the ZBC protein or variants thereof to a transcriptional activation domain: Transcriptional activation domains (TADS) are defined as discrete regions of proteins that promote gene expression by a variety of mechanisms that ultimately result in the activation of RNA polymerase. A TAD generally is defined as the minimal motif that activates transcription when fused to a DNA-binding domain (Webster et al. (1988), *Cell* 52: 169–178; Fischer et al. (1988), *Nature* 332: 853–856; Hope et al. (1988), *Nature* 333: 635–640).

As used for all aspects of the invention, the term "modulating the expression of a gene" means affecting the function of a gene's product, preferably by increasing or decreasing protein activity or creating a new protein activity through mutation; increasing or decreasing transcription; increasing or decreasing translation; increasing, decreasing or changing post-translational modification; altering intracellular localization; increasing or decreasing translocation; increasing or decreasing protein activity by fusion or by interaction of the protein with another molecule; and/or creating a new protein activity by interaction of the protein with another molecule. In some cases, such modulation is achieved by allowing or causing the expression of an exogenously supplied nucleic acid or gene, e.g., by transformation. In some cases, other exogenously supplied molecules can mediate the modulation. The modulation is not achieved, however, by simply randomly mutagenizing the fungus, either spontaneously or by chemical means. In certain embodiments, the ZBC gene is from an organism in which it is not present within a biosynthetic cluster, or the ZBC gene is not present in the biosynthetic cluster of the desired secondary metabolite to be regulated. In certain embodiments, the ZBC gene is from an organism other than the production fungus, preferably from a different species or genus. In certain embodiments, the ZBC gene in its native locus regulates a different secondary metabolite than the desired secondary metabolite produced by the production fungus. In certain embodiments, the ZBC gene in its native locus does not regulate secondary metabolism. "Native locus" means the chromosomal locus in the original organism from which the gene was cloned.

As used for all aspects of the invention, "mutation" means an alteration in DNA sequence, either by site-directed or random mutagenesis. Mutation encompasses point mutations as well as insertions, deletions, or rearrangements.

As used for all aspects of the invention, "mutant" means an organism containing one or more mutations.

In certain embodiments of the methods according to this aspect of the invention, the modulation is over-expression of the gene. "Over-expression of the gene" means transcription and/or translation and/or gene product maturation at a rate that exceeds by at least two-fold, preferably at least five-fold, and more preferably at least ten-fold, the level of such expression that would be present under similar growth conditions in the absence of the modulation of expression of the gene. "Similar growth conditions" means similar sources of nutrients such as carbon, nitrogen, and phosphate, as well as similar pH, partial oxygen pressure, temperature, concentration of drugs or other small molecules, and a similar substrate for growth, whether solid, semi-solid, or liquid.

In certain embodiments of the methods according to this aspect of the invention, the modulation is expression of a dominant mutation of the gene. The term "dominant mutation" is as used before. Preferred dominant mutations according to this aspect of the invention are as used before.

In certain embodiments of the methods according to this aspect of the invention, the modulation is conditional expression of the gene. "Conditional expression" of a gene means expression under certain growth conditions, but not under others. Such growth conditions that may be varied include, without limitation, carbon source, nitrogen source, phosphate source, pH, temperature, partial oxygen pressure, the presence or absence of small molecules such as drugs, and the presence or absence of a solid substrate.

In certain embodiments of the methods according to this aspect of the invention, the secondary metabolite is an anti-bacterial. An "anti-bacterial" is a molecule that has cytocidal or cytostatic activity against some or all bacteria. Preferred anti-bacterials include, without limitation, β-lactams. Preferred β-lactams include, without limitation, penicillins and cephalosporins. Preferred penicillins and biosynthetic intermediates include, without limitation, isopenicillin N, 6-aminopenicillanic acid (6-APA), penicillin G, penicillin N, and penicillin V. Preferred cephalosporins and biosynthetic intermediates include, without limitation, deacetoxycephalosporin V (DAOC V), deacetoxycephalosporin C (DAOC), deacetylcephalosporin C (DAC), 7-aminodeacetoxy-cephalosporanic acid (7-ADCA), cephalosporin C, 7-β-(5-carboxy-5-oxopentanamido)-cephalosporanic acid (keto-AD-7ACA), 7-β-(4-carboxybutanamido)-cephalosporanic acid (GL-7ACA), and 7-aminocephalosporanic acid (7ACA).

In certain embodiments of the methods according to this aspect of the invention, the secondary metabolite is an anti-hypercholesterolemic. An "anti-hypercholesterolemic" is a drug administered to a patient diagnosed with elevated cholesterol levels, for the purpose of lowering the cholesterol levels. Preferred anti-hypercholesterolemics include, without limitation, lovastatin, mevastatin, simvastatin, and pravastatin.

In certain embodiments of the methods according to this aspect of the invention, the secondary metabolite is an immunosuppressant. An "immunosuppressant" is a molecule that reduces or eliminates an immune response in a host when the host is challenged with an immunogenic molecule, including immunogenic molecules present on transplanted organs, tissues or cells. Preferred immunosuppressants include, without limitation, members of the cyclosporin family and beauverolide L. Preferred cyclosporins include, without limitation, cyclosporin A and cyclosporin C.

In certain embodiments of the methods according to this aspect of the invention, the secondary metabolite is an ergot alkaloid. An "ergot alkaloid" is a member of a large family of alkaloid compounds that are most often produced in the sclerotia of fungi of the genus Claviceps. An "alkaloid" is a small molecule that contains nitrogen and has basic pH characteristics. The classes of ergot alkaloids include clavine alkaloids, lysergic acids, lysergic acid amides, and ergot peptide alkaloids. Preferred ergot alkaloids include, without limitation, ergotamine, ergosine, ergocristine, ergocryptine, ergocornine, ergotaminine, ergosinine, ergocristinine, ergocryptinine, ergocorninine, ergonovine, ergometrinine, and ergoclavine.

In certain embodiments of the methods according to this aspect of the invention, the secondary metabolite is an inhibitor of angiogenesis. An "angiogenesis inhibitor" is a molecule that decreases or prevents the formation of new blood vessels. Angiogenesis inhibitors have proven effective in the treatment of several human diseases including, without limitation, cancer, rheumatoid arthritis, and diabetic retinopathy. Preferred inhibitors of angiogenesis include, without limitation, fumagillin and ovalicin.

In certain embodiments of the methods according to this aspect of the invention, the secondary metabolite is a glucan synthase inhibitor. A "glucan synthase inhibitor" is a molecule that decreases or inhibits the production of 1,3-β-D-glucan, a structural polymer of fungal cell walls. Glucan synthase inhibitors are a class of antifungal agents. Preferred glucan synthase inhibitors include, without limitation, echinocandin B, pneumocandin B, aculeacin A, and papulacandin.

In certain embodiments of the methods according to this aspect of the invention, the secondary metabolite is a member of the gliotoxin family of compounds. The "gliotoxin family of compounds" are related molecules of the epipolythiodioxopiperazine class. Gliotoxins display diverse biological activities, including, without limitation, antimicrobial, antifungal, antiviral, and immunomodulating activities. Preferred members of the "gliotoxin family of compounds" include, without limitation, gliotoxin and aspirochlorine.

In certain embodiments of the methods according to this aspect of the invention, the secondary metabolite is a fungal toxin. A "fungal toxin" is a compound that causes a pathological condition in a host, either plant or animal. Fungal toxins could be mycotoxins present in food products, toxins produced by phytopathogens, toxins from poisonous mushrooms, or toxins produced by zoopathogens. Preferred fungal toxins include, without limitation, aflatoxins, patulin, zearalenone, cytochalasin, griseofulvin, ergochrome, cercosporin, marticin, xanthocillin, coumarins, tricothecenes, fusidanes, sesterpenes, amatoxins, malformin A, phallotoxins, pentoxin, HC toxin, psilocybin, bufotenine, lysergic acid, sporodesmin, pulcheriminic acid, sordarins, fumonisins, ochratoxin A, and fusaric acid.

In certain embodiments of the methods according to this aspect of the invention, the secondary metabolite is a modulator of cell surface receptor signaling. As used herein, the term "cell surface receptor" means a molecule that resides at or in the plasma membrane, binds an extracellular signaling molecule, and transduces this signal to propagate a cellular response. Modulators of cell surface receptor signaling might function by one of several mechanisms including, without limitation, acting as agonists or antagonists; sequestering a molecule that interacts with a receptor, such as a ligand; or stabilizing the interaction of a receptor and a molecule with which it interacts. Preferred modulators of cell surface signaling include, without limitation, the insulin receptor agonist L-783,281 and the cholecystokinin receptor antagonist asperlicin.

In certain embodiments of the methods according to this aspect of the invention, the secondary metabolite is a plant growth regulator. A "plant growth regulator" is a molecule that controls growth and development of a plant by affecting processes that include, without limitation, division, elongation, and differentiation of cells. Preferred plant growth regulators include, without limitation, cytokinin, auxin, gibberellin, abscisic acid, and ethylene.

In certain embodiments of the methods according to this aspect of the invention, the secondary metabolite is a pigment. A "pigment" is a substance that imparts a characteristic color. Preferred pigments include, without limitation, melanins and carotenoids.

In certain embodiments of the methods according to this aspect of the invention, the secondary metabolite is an insecticide. An "insecticide" is a molecule that is toxic to at least some insects. A preferred insecticide, without limitation, is nodulisporic acid.

In certain embodiments of the methods according to this aspect of the invention, the secondary metabolite is an anti-neoplastic compound. An "anti-neoplastic" compound is a molecule that prevents or reduces tumor formation. Preferred anti-neoplastic compounds include, without limitation, taxol (paclitaxel) and related taxoids.

In certain embodiments of the methods according to this aspect of the invention, the methods further comprise purifying the secondary metabolite from a culture of the fungus. "Purifying" means obtaining the secondary metabolite in substantially pure form. "Substantially pure" means comprising at least 90%, more preferably at least 95%, and most preferably at least 99%, of the purified composition on a dry-weight basis.

In a second aspect, the invention provides methods for improving production of a secondary metabolite by a fungus by increasing productivity of the secondary metabolite in the fungus, the methods comprising modulating the expression of a ZBC gene or gene variant in a manner that improves the productivity of the secondary metabolite.

"Improves the productivity" means to increase the quotient of the concentration of the secondary metabolite divided by the product of the fermentor run-time multiplied by the fermentation volume multiplied by the grams of the dry cell weight of biomass (Productivity=concentration metabolite/(time×volume×gDCW)).

Significant advantages that might result from increasing productivity include, without limitation, a decrease in fermentor run-time, a decrease in the size of the fermentor required for production of equivalent amounts of secondary metabolite, or a decrease in the biomass required for production, which translates into decreased waste that must be handled in downstream processing. Preferably, such increased productivity is by at least ten percent, more preferably at least 50 percent, and most preferably at least two-fold.

"Modulating the expression of a ZBC gene" is as used before. In certain embodiments of the methods according to this aspect of the invention, the modulation is over-expression of the ZBC gene. "Over-expression of the gene" is as used before. In certain embodiments of the methods according to this aspect of the invention, the modulation is expression of a dominant mutation of the gene. The term "dominant mutation" is as used before. Preferred dominant mutations according to this aspect of the invention are as used before. In certain embodiments of the methods according to this aspect of the invention, the modulation is conditional expression of the gene. The term "conditional expression" of a gene is as used before.

In the methods according to this aspect of the invention, the term "secondary metabolite" is as used previously and preferred secondary metabolites include, without limitation, those discussed previously. In certain embodiments of the methods according to this aspect of the invention, the methods further comprise purifying the secondary metabolite from a culture of the fungus. The term "purifying" is as used before.

In a third aspect, the invention provides methods for improving production of a secondary metabolite in a fungus by increasing efflux or excretion of the secondary metabolite, the method comprising modulating the expression of a ZBC gene or gene variant in a manner that increases efflux or excretion of the secondary metabolite.

"Increasing efflux or excretion of the secondary metabolite" means that, without lysing a fungal cell, a greater quantity of the secondary metabolite passes from the inside of the fungal cell to the outside of the fungal cell per unit time. "Outside of the fungal cell" is defined as being no longer contained wholly within the lipid bilayer of the cell and/or extractable from the cell with methods which do not release a majority of intracellular contents.

"Modulating the expression of a ZBC gene" is as used before, except that the ZBC gene can be the Aspergillus spp. aflR gene when the secondary metabolite is aflatoxin or sterigmatocystin, and the ZBC gene can be lovE when the secondary metabolite is lovastatin. In certain embodiments of the methods according to this aspect of the invention, the modulation is over-expression of the gene. "Over-expression of the gene" is as used before. In certain embodiments of the methods according to this aspect of the invention, the modulation is expression of a dominant mutation of the gene. The term "dominant mutation" is as used before. Preferred dominant mutations according to this aspect of the invention are as used before. In certain embodiments of the methods according to this aspect of the invention, the modulation is conditional expression of the gene. The term "conditional expression" of a gene is as used before.

In the methods according to this aspect of the invention, the term "secondary metabolite" is as used previously and preferred secondary metabolites include, without limitation, those discussed previously. In certain embodiments of the methods according to this aspect of the invention, the methods further comprise purifying the secondary metabolite from a culture of the fungus. The term "purifying" is as used before.

In a fourth aspect, the invention provides methods for improving production of a secondary metabolite in a fungus by decreasing production of side products or non-desired secondary metabolites, the method comprising modulating the expression of a ZBC gene or gene variant in a manner that decreases production of side products or non-desired secondary metabolites.

"Decreasing production of side products or non-desired secondary metabolites" means reducing the amount of such side products or non-desired secondary metabolites that are synthesized or which are retained within the cells or the media surrounding the cells. Preferably, such reduction is at least by 25%, more preferably by at least 50%, even more preferably by at least 2-fold, and most preferably by at least 5-fold.

"Modulating the expression of a ZBC gene" is as used for the third aspect of the invention. In certain embodiments of the methods according to this aspect of the invention, the modulation is over-expression of the gene. "Over-expression of the gene" is as used before. In certain embodiments of the methods according to this aspect of the invention, the modulation is expression of a dominant mutation of the gene. The term "dominant mutation" is as used before. Preferred dominant mutations according to this aspect of the invention are as used before. In certain embodiments of the methods according to this aspect of the invention, the modulation is conditional expression of the gene. The term "conditional expression" of a gene is as used before.

In the methods according to this aspect of the invention, the term "secondary metabolite" is as used previously and preferred secondary metabolites include, without limitation, those discussed previously. In certain embodiments of the methods according to this aspect of the invention, the methods further comprise purifying the secondary metabolite from a culture of the fungus. The term "purifying" is as used before.

In a fifth aspect, the invention provides methods for improving production of a secondary metabolite in a fungus by altering the characteristics of the fungus in a manner that is beneficial to the production of the secondary metabolite, the method comprising modulating the expression of a ZBC gene or gene variant in a manner that alters the characteristics of the fungus.

"Altering the characteristics" means changing the morphology or growth traits of the fungus. Preferred alterations include, without limitation, alterations that result in transition of the fungus from the hyphal to the yeast form; alterations that result in transition of the fungus from the yeast to the hyphal form; alterations that lead to more or less hyphal branching; alterations that increase or decrease flocculence, adherence, cell buoyancy, surface area of the fungus, cell wall integrity and/or stability, pellet size, vacuole formation, and/or ability to grow at higher or lower temperatures; and alterations that increase the saturating growth density of a culture or rate of pellet formation.

"Modulating the expression of a ZBC gene" is as used for the third aspect of the invention. In certain embodiments of the methods according to this aspect of the invention, the modulation is over-expression of the gene. "Over-expression of the gene" is as used before. In certain embodiments of the methods according to this aspect of the invention, the modulation is expression of a dominant mutation of the gene. The term "dominant mutation" is as used before. Preferred dominant mutations according to this aspect of the invention are as used before. In certain embodiments of the methods according to this aspect of the invention, the modulation is conditional expression of the gene. The term "conditional expression" of a gene is as used before.

In the methods according to this aspect of the invention, the term "secondary metabolite" is as used previously and preferred secondary metabolites include, without limitation, those discussed previously. In certain embodiments of the methods according to this aspect of the invention, the methods further comprise purifying the secondary metabolite from a culture of the fungus. The term "purifying" is as used before.

In a sixth aspect, the invention provides methods for improving production of a secondary metabolite in a fungus by causing conditional lysis of the fungus, the method comprising modulating the expression of a ZBC gene or gene variant in a manner that causes conditional lysis.

"Causing conditional lysis" means causing the fungus to grow without lysis under a first set of growth conditions and to lyse under a second and different set of conditions, which are not lytic to the unmodified fungus. In preferred embodiments, the conditions that can be altered between the first and second growth conditions include, without limitation, the source or amount of nutrients such as carbon, nitrogen, and phosphate; the source or amount of specific enzymes; the source or amount of specific components found in cell walls; the amount of salts or osmolytes; the pH of the medium; the partial oxygen pressure; temperature; and the amount of specific small molecules.

"Modulating the expression of a ZBC gene" is as used for the third aspect of the invention. In certain embodiments of the methods according to this aspect of the invention, the modulation is over-expression of the gene. "Over-expression of the gene" is as used before. In certain embodiments of the methods according to this aspect of the invention, the modulation is expression of a dominant mutation of the gene. The term "dominant mutation" is as used before. Preferred dominant mutations according to this aspect of the invention are as used before. In certain embodiments of the methods according to this aspect of the invention, the modulation is conditional expression of the gene. The term "conditional expression" of a gene is as used before.

In the methods according to this aspect of the invention, the term "secondary metabolite" is as used previously and preferred secondary metabolites include, without limitation, those discussed previously. In certain embodiments of the methods according to this aspect of the invention, the methods further comprise purifying the secondary metabolite from a culture of the fungus. The term "purifying" is as used before.

In a seventh aspect, the invention provides methods for improving production of a secondary metabolite in a fungus by increasing the resistance of the fungus to the deleterious effects of exposure to a secondary metabolite made by the same organism, the method comprising modulating the expression of a ZBC gene or gene variant in a manner that increases resistance to the deleterious effects of exposure to a secondary metabolite. As used herein, the phrase "increasing the resistance of the fungus to the deleterious effects of exposure to a secondary metabolite" means to allow the fungus to survive, grow, or produce the secondary metabolite in conditions that otherwise would be toxic to the fungus or prevent the production of the secondary metabolite. In particular, the growth of a fungus that produces a secondary metabolite can be limited, in part, by the toxic effects of the secondary metabolite itself. In the absence of resistance mechanisms to protect the fungi from the toxic effects of these metabolites, decreased yields of the metabolite can be observed. For example, Alexander et al. (1999), *Mol. Gen. Genet.* 261: 977–84, have shown that the trichothecene efflux pump of *Fusarium sporotrichiodes*, encoded by the gene TRI12, is required both for high level production of, and resistance to the toxic effects of, trichothecenes produced by this fungus. Thus, modifications that increase the resistance of a fungus to a toxic secondary metabolite that it produces can increase the saturation density and extend the metabolically active lifetime of the producing fungus. In a bioreactor, such attributes will have the beneficial effect of increasing the yield and productivity of a metabolite. Regulators of secondary metabolite production whose expression can be modulated to increase resistance of a fungus to toxic metabolites can include, without limitation, transporters that promote efflux of the metabolite from cells, enzymes that alter the chemical structure of the metabolite within cells to render it non-toxic, target(s) of the metabolite that mediate its toxicity, and gene products that alter cellular processes to counteract the toxic effects of a metabolite. Additional benefits of increasing efflux of secondary metabolites include increasing the amount of metabolite available for purification from the fermentation broth and mitigation of feedback inhibition of secondary metabolism that may be mediated by the metabolite itself. Indeed, feedback inhibition of a biosynthetic pathway by a product of that pathway is well documented in many microorganisms, and this inhibition can act at the transcriptional, translational, and post-translational levels. Several well-documented examples in yeast include the transcriptional repression of lysine biosynthetic genes by lysine (Feller et al. (1999), *Eur. J. Biochen.* 261: 163–70), the decreased stability of both the mRNA encoding the uracil permease Fur4p and the permease itself in the presence of uracil (Seron et al. (1999), *J. Bacteriol.* 181: 1793–800), and the inhibition of alpha-isopropyl malate synthase, a key step in leucine biosynthesis, by the presence of leucine (Beltzer et aL (1988), *J. Biol. Chem.* 263: 368–74).

Transcription factors that regulate the expression of efflux pumps could also be used to increase efflux of a drug from a fungal cell to increase the yields of a metabolite and decrease the toxicity of the secondary metabolite in a fermentation. Such transcription factors include, but are not limited to, ZBC genes such as PDR1, and PDR3 from *S. cerevisiae* and their homologs. Over-expression of each of these genes has been shown to up-regulate expression of transporters and cause increased resistance of *S. cerevisiae* to toxic compounds (for examples, see Reid et al. (1997), *J. Biol. Chem.* 272: 12091–9; Katzmann et al. (1994), *Mol. Cell. Biol.* 14: 4653–61; Wendler et al. (1997), *J. Biol. Chem.* 272: 27091–8).

Increases in resistance to the toxic effects of secondary metabolites will vary with the metabolite. For example, amatoxins kill cells by inhibiting the function of the major cellular RNA polymerase, RNA polymerase II, in eucaryotic cells. Mutant forms of RNA polymerase II resistant to the effects of alpha-amanitin have been described (Bartolomei et al. (1988), *Mol. Cell. Biol.* 8: 330–9; Chen et al. (1993), *Mol. Cell. Biol.* 13: 4214–22). Similarly, mutations affecting HMG CoA reductase, the target enzyme for the secondary metabolite lovastatin, have been identified. Increased levels of HMG CoA Reductase can also cause resistance to lovastatin (Ravid et al. (1999), *J. Biol. Chem.* 274: 29341–51; Lum et al. (1996), *Yeast* 12: 1107–24). Taxol (paclitaxel), causes lethality by increasing microtubule stability, thus preventing exit from mitosis. Dominant mutations affecting β-tubulin that confer resistance to taxol have been characterized (for example, see Gonzalez et al. (1999), *J. Biol. Chem.* 274: 23875–82) and could prove to be useful to confer resistance to this toxic metabolite in production strains. The pneumocandin and echinocandin families of metabolites are fungal secondary metabolites that inhibit the enzyme 1,3-β-D-glucan synthase. Dominant mutations in the *C. albicans* glucan synthase gene, FKS1, have been shown to confer resistance to candins (Douglas et al. (1997), *Antinzicrob. Agents Chemother.* 41: 2471–9). Glucan synthase mutations such as these could be used to generate fungal production strains with increased resistance to the candin class of antifungals. *S. cerevisiae* mutants resistant to the growth-inhibitory effects of the fungal secondary metabolite cyclosporin A have also been described (Cardenas et al. (1995), *EMBO J.* 14: 2772–83). These mutants were shown to harbor mutations in CNA1, the gene encoding the catalytic subunit of the heterodimeric calcium-calmodulin dependent phosphatase, calcineurin A. Fumagillin, an antiangiogenic agent, binds to and inhibits the N-terminal aminopeptidases in a wide variety of both pro-caryotes and eucaryotes (Sin et al. (1997), *Proc. Natl. Acad. Sci. USA* 94: 6099–103, Lowther et al. (1998), *Proc. Natl. Acad Sci. USA* 95: 12153–7). Mutations in this enzyme that block fumagillin binding and/or inhibitory activity could well prove useful in enhancing the resistance of fungal production strains to the growth inhibitory effects of this secondary metabolite.

"Modulating the expression of a ZBC gene" is as used for the third aspect of the invention. In certain embodiments of the methods according to this aspect of the invention, the modulation is over-expression of the gene. "Over-expression of the gene" is as used before. In certain embodiments of the methods according to this aspect of the invention, the modulation is expression of a dominant mutation of the gene. The term "dominant mutation" is as used before. Preferred dominant mutations according to this aspect of the invention are as used before. In certain embodiments of the methods according to this aspect of the invention, the modulation is conditional expression of the gene. The term "conditional expression" of a gene is as used before.

In the methods according to this aspect of the invention, the term "secondary metabolite" is as used previously and preferred secondary metabolites include, without limitation, those discussed previously. In certain embodiments of the methods according to this aspect of the invention, the methods further comprise purifying the secondary metabolite from a culture of the fungus. The term "purifying" is as used before.

In an eighth aspect, the invention provides methods for improving production of a secondary metabolite in a fungus by modulating the expression of one or more genes, the method comprising modulating the expression of a ZBC gene or gene variant that does not normally modulate the expression of such gene or genes.

In a ninth aspect, the invention provides genetically modified fungi, wherein the genetically modified fungi have an ability to produce secondary metabolites and the ability of the genetically modified fungus to produce secondary metabolites has been improved by any of the methods according to the invention.

In a tenth aspect, the invention provides a method for making a secondary metabolite, the method comprising culturing a genetically modified fungus according to the invention under conditions suitable for the production of secondary metabolites.

Nine ZBC genes (and derivatives thereof) have been tested to date for effects on either lovastatin yield in *A. terreus* or penicillin production in *P. chrysogenum*, and in some cases both. Of these genes (lovE, lovU, An13, At18, CAT8, SIP4, LYS14, tamA, and YAF1) three of the nine (lovU, At18 and LYS14), or 33%, have demonstrable positive effects on metabolite production. Details of the lovU, At18 and LYS14 results are described in the examples presented below.

The following examples illustrate some preferred modes of practicing the present invention, but are not intended to limit the scope of the claimed invention. Alternative materials and methods may be utilized to obtain similar results.

EXAMPLE 1

Construction of an Expression Vector for the At18 Gene from *A. terreus*.

To test whether a ZBC gene that is not encoded within the biosynthetic cluster for the production of a specific metabolite can regulate the biosynthesis of that specific metabolite, the ZBC-encoding At18 gene from *A. terreus* was tested for effects on lovastatin production. To over-express At18 (SEQ ID NO 51) in *A. terreus*, At18 was amplified with oligonucleotides MO1715 (SEQ ID NO 1) and MO1716 (SEQ ID NO 2) using Turbo Pfu DNA Polymerase and a cDNA clone of At18 as a template under standard conditions for polymerase chain reaction (PCR). A GATEWAY Cloning Technology (Invitrogen Corp., Carlsbad, Calif.) entry vector was produced from the resultant PCR product and the GATEWAY pDONR206 entry plasmid according to manufacturer's instructions. The resultant vector, MB1754, was then reacted in a with plasmid MB1419 to form an expression vector according to manufacturer's instructions. MB1419 is derived from pLXZ161, a vector derived from pBC-phleo (Silar (1995), *Fungal Genetics Newsletter* 42: 73) that carries a phleomycin resistance cassette for selection of transformants in *A. terreus*, as well as a polylinker located between the *A. nidulans* PGK promoter and the *A. nidulans* trpc terminator. pLXZ161 is constructed as follows: First, the *A. nidulans* trpC terminator is amplified from genomic DNA by the PCR using Turbo Pfu Polymerase as described by the manufacturer (Stratagene, La Jolla, Calif.). Primers used in this reaction are TRPC-1 (SEQ ID NO 3) and TRPC-2 (SEQ ID NO 4). The resultant product is digested with the restriction enzymes SacII and NotI, purified by agarose gel electrophoresis, and cloned into SacII/NotI-digested pBC-phleo DNA, to generate pLXZ116. Second, the *A. nidulans* PGK promoter is amplified from *A. nidulans* genomic DNA by PCR using primers PGK1-1 (SEQ ID NO 5) and PGK1-2 (SEQ ID NO 6), Turbo Pfu Polymerase, and the reaction conditions as described above. The resultant product is digested with ApaI and ClaI and cloned into ApaIClaI-digested pLXZ116, to generate pLXZ161. To produce MB1419, the ccdB (death gene) cassette from pEZC7201 (hnvitrogen Corp., Carlsbad, Calif.) was amplified by PCR using oligos MO511 (SEQ ID NO 7) and MO512 (SEQ ID NO 8), digested with ClaI and NotI, and cloned into NotI/ClaI-digested pLXZ161. This generated an expression vector in which the death gene cassette resides between the *A. nidulans* PGK promoter and the *A. nidulans* trpC terminator of pLXZ161. The reactions using this vector allow configuration of any gene in an entry clone to be expressed under the control of the *A. nidulans* PGK promoter (see GATEWAY Cloning Technology manual, Invitrogen Corp., Carlsbad, Calif.). The fungal selectable marker contained on this plasmid is ble, which confers resistance to phleomycin. Reaction of MB1754 with MB1419 yielded a clone (MB1970) which is configured to express At18 under control of the *A. nidulans* PGK promoter, with the terminator region from the *A. nidulans* trpC gene acting as a transcriptional terminator.

EXAMPLE 2

Transformation of *A. terreus* with a ZBC Gene

For transformation of *A. terreus*, spores were first generated by culture of strain ATCC#20542 on petri plates containing potato dextrose agar (PDA, Becton Dickinson & Co., Sparks, Mo.) at 30° C. for 3–6 days. Spores were removed from PDA either by resuspension in sterile water or Tween-80 (0.1%) or by scraping directly from the plate using a sterile spatula. Yeast extract sucrose (YES) medium (2% yeast extract, 6% sucrose) was inoculated to a density of $1–5 \times 10^6$ spores per ml and incubated with shaking in an Erlenmeyer flask at 26–30° C. for 12–16 hr (250 rpm). Mycelia were harvested by centrifugation at 3200 rpm for 10 minutes, and washed in sterile water twice. Mycelia were resuspended in a filter-sterilized solution of Novozyme 234 (Sigma, St. Louis, Mo.) at 2–5 mg/ml in 1 M $MgSO_4$ and digested at room temperature with shaking (80 rpm) for 1–2 hr. Undigested material was removed from the digest by filtration through a rayon-polyester cloth with acrylic binder and 22–25 μm pores (MIRACLOTH, Calbiochem, San Diego, Calif.). After adding 1–2 volumes of STC (0.8 M sorbitol, 25 mm Tris, pH 7.5, and 25 mM CaCl$_2$), the protoplasts were pelleted by centrifugation at 2500 rpm. Protoplasts were washed twice in STC by centrifugation. Resulting protoplasts were resuspended to a density of 5×10$^7$ per ml in a solution of STC, SPTC (40% polyethylene glycol in STC) and DMSO in a ratio of 9:1:0.1 and frozen at −80° C. Two aliquots (100 μl each) of protoplasts were mixed with 1–5 μg of either pBCphleo or MB1970 DNA and incubated on ice for 30 min. An aliquot of SPTC (15 μl) was added to each tube and the reaction was incubated at room temperature for 15 minutes. An additional aliquot (500 μl) was added with gentle mixing, and the reaction was incubated for an additional 15 minutes at room temperature. The reaction was next resuspended in 25 ml of molten regeneration medium (PDA from Sigma, St Louis, Mo.) with 0.8 M sucrose, maintained at 50° C.), and poured onto a 150 mm petri plate containing 25 ml of solidified regeneration medium plus phleomycin (60–200 μg/ml). Transformants were typically visible after 2–5 days of incubation at 26–30° C.

*A. terreus* transformants were grown on modified RPM medium (WO 00/37629) containing 4% glucose, 0.3% corn steep liquor (Sigma, St. Louis, Mo.), 0.2% KNO$_3$, 0.3% KH$_2$PO$_4$, 0.05% MgSO$_4$.7H$_2$O, 0.05% NaCl, 0.05% polyglycol (Dow Chemical Co., Midland, Mich.), 0.1% trace elements (14.3 g/l ZnSO$_4$.7H$_2$O, 2.5 g/l CuSO$_4$.5H$_2$O, 0.5 g/l NiCl$_2$.6H$_2$O, 13.8 g/l FeSO$_4$ 7H$_2$O, 8.5 g/l MnSO$_4$.H$_2$O, 3 g/l citric acid.H$_2$O(add first), 1 g/l H$_3$BO$_3$, 1 g/l Na$_2$MoO$_4$, 2.5 g/l CoCl$_2$ 6H$_2$O). The final pH was adjusted to 6.5. Spores for the inoculum were generated by culturing on plates containing minimal medium plus phleomycin for 1 week at 27 C. Spores for shake flask inoculation were removed from plates by dragging the tip of a sterile wooden stick approximately 1 inch across the plate surface. The tip of the stick was then dipped into the shake flask medium and swirled gently. Cultures were grown at 27° C., 225 RPM for 5–6 days.

EXAMPLE 3

Determination of Lovastatin Production

Lovastatin is known to inhibit the enzyme HMG-CoA reductase (HMGR) which converts hydroxymethylglutaryl coenzyme A (HMGCoA) and NADPH to mevalonate and NADP. This reaction can be quantified by measuring the change in absorbance of NADPH. To assay lovastatin production, 6-histidine tagged HMGR ((His)$_6$HMGR) was first expressed in *S. cerevisiae* and purified with a nickel column. *A. terreus* samples were fermented as described above and 0.5 mL samples were taken at day 5–6, put in a 1 mL 96-well plate and centrifuged to remove mycelia before assaying. Samples were transferred to another 1 mL 96-well plate and frozen at −80° C.

Samples were thawed and 10 μL removed and diluted 1:50 in H$_2$O. 10 μl of this diluted broth was assayed in a reaction (200 μL total) containing 1 mM L-HMGCoA, 1 mM NADPH, 0.005 mM DTT and 5 μL (His)$_6$HMGR. The disappearance of absorbance at 340 nm was observed over time. This represented the disappearance of NADPH. Lovastatin inhibits this reaction. The initial velocities were calculated for the reactions containing samples, adjusted for dilution and compared to reactions containing lovastatin standards to determine levels of metabolite produced by regression analysis. The amounts of lovastatin produced by six At18 transformants and six pBC-phleo (vector) transformants were determined. The median value of lovastatin production by the vector transformants was approximately 100 micrograms/mL broth whereas that of the At18 transformants was approximately 210 micrograms/ml broth. These results demonstrate that a ZBC gene that is not encoded within the biosynthetic gene cluster of a particular secondary metabolite can nonetheless regulate the production of that metabolite.

EXAMPLE 4

Construction of an Expression Vector for the lovU Gene from *A. terreus*.

To test lovU (previously designated as orf13 in *A. terreus*, Genbank ID 4959954) function in *P. chrysogenum*, lovU was amplified by PCR under standard conditions well known to those in the art, using *A. terreus* first strand cDNA as template. To generate first strand cDNA, *A. terreus* (MF22; ATCC#20542) was grown for 45 hours in Production Media (Cerelose, 4.5% (w/v), Peptonized Milk, 2.5% (w/v), Autolyzed yeast, 0.25% (w/v), Polyglycol P2000, 0.25% (w/v), pH to 7.0) at 25° C. Mycelia were harvested in a 50 cc syringe plugged with sterile cotton wool using a vacuum apparatus, washed once with sterile H$_2$O, and snap frozen in liquid nitrogen. Mycelia were then ground to a powder under liquid nitrogen with a mortar and pestle, and homogenized in RLC buffer (RNeasy Kit; Qiagen, Inc., Valencia, Calif.) using a GLH rotor-stator homogenizer (Omni International, Warrenton, Va.) Total RNA was purified using an RNeasy Maxi column according to the instructions of the manufacturer.

The polyA+fraction of the *A. terreus* total RNA was isolated using Oligotex beads (Qiagen, Inc., Valencia, Calif.). Purified polyA+RNA (5 μg) was used to generate complementary DNA (cDNA) using SUPERSCRIPT reverse transcriptase (Gibco BRL, Rockville, Md.) according to the manufacturer's instructions. First strand cDNA was used to amplify cDNA predicted to encode lovU using PCR. Oligos used to amplify the lovU cDNA were MO843 (SEQ ID NO 9) and MO844 (SEQ ID NO 10). The resultant lovU PCR product was cloned using GATEWAY Cloning Technology (Invitrogen Corp., Carlsbad, Calif.) to generate the entry clone MB1201. This vector was then used to generate the expression vector MB1317 which encodes lovU under control of the *A. nidulans* PGK promoter. The dominant selectable marker for transformation on this vector is the ble gene under control of the *A. nidulans* GPD promoter, which confers resistance to the antimicrobial agent phleomycin.

EXAMPLE 5

Transformation of *P. chrysogenum* Strains MF1 and MF20

MB1325 (a control plasmid expressing the ble marker gene which causes phleomycin resistance) and MB1317 were transformed into *P. chrysogenum* strains MF1 (NRRL1951) and MF20 (ATCC 11702). Transformation was accomplished in the same manner as described above for *A. terreus*, except transformants were selected on 30 μg/mL phleomycin. To test levels of penicillin produced in *P. chrysogenum* transformants, a plug containing spores and mycelia was used as the inoculum. The medium used was the published P2 production medium (Lein (1986), in *Overproduction of Microbial Metabolites*, pp. 105–139, Vanek and Hostalek (eds.), Butterworth Heinemann, Woburn, Mass.) which contains, 30% lactose, 5× pharmamedia cotton seed flour, ammonium sulfate, calcium carbonate, potassium phosphate, potassium sulfate, and phenoxyacetic acid, at pH 7. Flasks were incubated at 26° C. with shaking at 225 rpm.

Sampling was done after 6 days of growth. 1–1.5 ml of supernatant is placed into 96-well plates. Plates were centrifuged and supernatants transferred to a new 96-well plate. Standard samples contained 0, 25, 50, 100, 200, 300, 400, and 500 µg/mL phenoxymethylpenicillin (sodium salt) dissolved in 10 mM potassium phosphate (pH 7.0), and assays were conducted as described below.

EXAMPLE 6

Determination of Penicillin Production

Fermentation broth was clarified by centrifugation for 10 min at 4000 g, and 40 µL of clarified fermentation broth and penicillin standard solutions was pipetted into individual wells of a 96-well UV collection plate. Next, 200 µL of imidazole reagent was pipetted into a 96-well filter plate (0.45 micron). The derivatization reaction of penicillin was initiated by vacuum filtration of imidazole reagent into a collection plate containing the aliquoted samples and standards. The collection plate was placed into a 96-well plate reader at 45 degrees while absorbance at 325 nm was monitored over 20 minutes. A Molecular Dynamics (Sunnyvale, Calif.) 96-well UV/Vis plate reader was used for all spectrophotometric detection. A 1.2 M aqueous imidazole solution containing mercuric chloride at a concentration of 1 mM, pH 6.8 was prepared as follows: 8.25 g of imidazole was dissolved in 60 mL of water, 10 mL of 5 M HCl was added, and then 10 ML of a solution of mercuric chloride (0.27 g dissolved in 100 mL of water) was added. The pH was adjusted to 6.80+/−0.05 with 5 M HCl and the volume was brought to 100 mL with water (see, e.g., Bundgaard and Ilver (1972), *Journal of Pharm. Pharmac:* 24: 790–794). Results for the effect of lovU on penicillin production in MF1 are shown in FIG. 2, and the results for the effect of lovU in MF20 are shown in FIG. 3. These results demonstrate that ZBC genes from one fungal genus can regulate a biosynthetic cluster or secondary metabolite production in a fungus from a different genus.

EXAMPLE 7

Effect of At18 on Lovastatin Productivity

The At18 construct according to Example 1 is used to transform *A. terreus* according to Example 2. Lovastatin concentration is determined according to Example 3, except that it is measured as the amount of lovastatin per unit volume of broth per gram of dry cell weight at each 24 hour time point of the fermentation and expressed as concentration as a function of fermentation time. Transformants with increased productivity, relative to vector controls, have a higher concentration of lovastatin at earlier time points.

EXAMPLE 8

Effect of At18 on Undesired Metabolites

The At18 construct according to Example 1 is used to transform *A. terreus* according to Example 2. Transformants are grown in production media and sampled at six and twelve days. The concentration of the undesired polyketide metabolite sulochrin is measured in samples of the whole fermentation broth (broth plus cell mass) at various time points for every sample. For each whole broth sample, the pH is adjusted to 7.7 and an equal volume of methanol is added. These whole broth/methanol extracts are assessed for the concentration of sulochrin at each time point using HPLC analysis. Conditions for determining sulochrin concentrations by HPLC are standard (see, e.g., Vinci et aL (1991), *J. Ind. Microbiol.* 8: 113–120) and involve separation on a C-8 HPLC column using a mobile phase of 0.1% $H_3PO_4$-acetonitrile (40:60, v/v) and measurement of absorbance by sulochrin at 238 nm (see, e.g., Schimmel and Parsons (1999), *Biotechnology Techniques* 13:379–384.)

EXAMPLE 9

Construction of an Expression Vector for the LYS14 Gene from *S. cerevisiae*.

To test *S. cerevisiae* LYS14 function in *A. terreus*, LYS14 was amplified by PCR under standard conditions from *S. cerevisiae* genomic library DNA using primers MO931 (SEQ ID NO 11) and MO932 (SEQ ID NO 12). The resultant 2.4 kb PCR product was cloned using GATEWAY Cloning Technology (Invitrogen Corp., Carlsbad, Calif.) to generate entry clone MB1567. Using methods well known to those experienced in the art, MB1567 was used to generate filamentous fungal expression plasmids MB1669, MB3130, and MB3139 which encode LYS14 under the control of, respectively, the *A. nidulans* PGK (MB1669 and MB3130) and *A. nidulans* GPD (MB3139) promoters. The dominant selectable marker for transformation on MB1669 is the ble gene under control of the *A. nidulans* GPD promoter, which confers resistance to the antimicrobial agent phleomycin. MB3130 and MB3139 contain the ble gene under control of the *A. nidulans* trpC promoter. Corresponding vector-only controls for the LYS14 expression plasmids are MB2143 (GPD-ble) and MB2941 (trpC-ble).

EXAMPLE 9

Determination of Lovastatin Production.

100 µL of broth sample was removed and diluted 1:10 into 70% $H_2O$-30% acetonitrile (900 µl). This mixture was spun down to pellet debris at 13000 rpm for 5 minutes. 900 µl of this diluted broth was transferred to a vial and the sample was analyzed by HPLC. 10 µl were injected into a Waters HPLC system (996 photo-diode array detector, 600 E pump controller and 717 autosampler) equipped with a YMC-Pack ODS column (Aq-302–3, 150×4.6 mm ID, S-3 µM pore size) and eluted with isocratic 40% aqueous acetic acid (0.7%)–60% acetonitrile for 8 minutes. Lovastatin was detected at 238 nm, found to have a retention time of 6.5 minutes, and was quantitated using a calibration curve created from pure lovastatin samples.

EXAMPLE 10

Effect of LYS14 on Lovastatin Production.

The LYS14 constructs according to Example 8 was used to transform *A. terreus* according to the method of Example 2. Lovastatin concentration was determined according to the methods of Example 9.

Thus, *A. terreus* strain MF22 was transformed with MB2143 (GPD-ble vector control), MB1669 (PGK-LYS14, GPD-ble), MB2941 (trpC-ble vector control), MB3130 (PGK-LYS14, trpC-ble) and MB3139 (GPD-LYS14, trpC-ble). Lovastatin concentration from the corresponding vec tor-only was used as a control. For example, MB2143 was the vector control for MB1669. The median value and highest data point for lovastatin production of the LYS14 expression plasmids MB1669 and MB3139 was greater than that of the corresponding vector only controls. In contrast, the median value for MB3130 (PGK-LYS14, trpC-ble) was lower than that of the corresponding vector-only control, suggesting that the different properties of the expression vector can influence ability of the construct to integrate, the locus of integration, copy number, etc. Similar results, in which some vectors work better than others, have been observed for other genes. Therefore, one of skill in the art can test more than one vector to optimize results.

EQUIVALENTS

While this invention has been particularly shown and described with references to preferred embodiments thereof, it will be understood by those skilled in the art that various changes in form and details may be made therein without departing from the spirit and scope of the invention as defined by the appended claims. Those skilled in the art will recognize, or be able to ascertain using no more than routine experimentation, many equivalents to the specific embodiments of the invention described specifically herein. Such equivalents are intended to be encompassed in the scope of the appended claims.

SEQUENCE LISTING (308 sequences)

SEQ ID NO: 1 - DNA, 1191 bp, Aspergillus  terreus
atgttcgcagaatcccaaccccccagcagcggtggcgacacccccaagctccgggcggcttgtgagaactgccgtcagtcgaaagtgaaatgcaacctgggagggaagaacacctgcatccgctgtcttcgccatggccttccttgtcgataccgggtcgccaaccgatccggcaagccgaaggggagcaagaaccgagctacgctgcgaaagctgggccagctccaggacgagaagccggtgcagggctcgcacagcgcgcgggagccgaagaaggccgtggagccggtgtgtccgccggagtatgaggtcgaccgcagattcgagtaccagacaagcgagccgagtcagccgcggctgtctgagagtccacatatgcacgactcccacccgacaatcgacgcctgcatgctagtgaatgagacgcccatcgactacacggctacctatggcggcccgttctcccccgccatgccgatgtgcacgccggcgtcgatgtcgccgacatcgcccaccttcctgcaaaaggagttcatcacgaaaggcctgaccagcttcccgctggccgtgcacgtccccggcgccttaccgccgcgctgcgagtgcgacgaggcgctcggcttccacttgaacggactgcgacatatggtggtcgacccggcgcggctgcgcttcgaccagggcctgcaggcgatcaagacggcgctcgccgtatgtcaggggttcctgcggtgcgcgcgctgtccaaagggcaacacgaacttcctggtctcgctgtcgacgctggacctcgtgctgcagctcttcgacttctgggtgagttgcgagttcgcagcccacggccacggccacgggccgccggcgtcgtcgctggaggccgagcccatggcttacggcgagtacgagacagcgcccgaggaggcgcggcacatgcggcgggtggtgctgcgcgggcgcctgctgcagtgcaaggaggtgctgggcctgctgcacgaggccgtggagctggccgagggccagggcctgagcagtagcagcagcagtagcgaggcgctggacgggagctggctgcagcagatcatccgcgggtatgcgagcgcgacggagtccctcctccagccgctggggtgtatttgcggaggcagcgcggtgcaactagcgcatagaccgagtaccgggttagataggctg

SEQ ID NO: 2 - protein, 397 aa, Aspergillus terreus
MFAESQPPSSGGDTPKLRAACENCRQSKVKCNLGGKNTCIRCLRHGLPCRYRVANRSGKPKGSKNRATLRKLGQLQDEKPVQGSHSAREPKKAVEPVCPPEYEVDRRFEYQTSEPSQPRLSESPHMHDSHPTIDACMLVNETPIDYTATYGGPFSPAMPMCTPASMSPTSPTFLQKEFITKGLTSFPLAVHVPGALPPRCECDEALGFHLNGLRHMVVDPARLRFDQGLQAIKTALAVCQGFLRCARCPKGNTNFLVSLSTLDLVLQLFDFWVSCEFAAHGHGHGPPASSLEAEPMAYGEYETAPEEARHMRRVVLRGRLLQCKEVLGLLHEAVELAEGQGLSSSSSSSEALDGSWLQQIIRGYASATESLLQPLGCICGGSAVQLAHRPSTGLDRL

SEQ ID NO: 3 - DNA, 40 bp, Aspergillus terreus
acaaaaaagcaggctccacaatgttcgcagaatcccaacc

SEQ ID NO: 4 - DNA, 35 bp, Aspergillus terreus
acaagaaagctgggtctacagcctatctaacccgg

SEQ ID NO: 5 - DNA, 34 bp, Aspergillus nidulans
gcggccgcggcgcccggcccatgtcaacaagaat

SEQ ID NO: 6 - DNA, 25 bp, Aspergillus nidulans
ccgcggccgagtggagatgtggagt

SEQ ID NO: 7 - DNA, 30 bp, Aspergillus nidulans
catggggccccgtgatgtctacctgcccac

SEQ ID NO: 8 - DNA, 30 bp, Aspergillus nidulans
catgatcgattgtgggtagttaatggtatg

SEQ ID NO: 9 - DNA, 35 bp, Escherichia coli
ggccatcgatacaagtttgtacaaaaaagctgaac

SEQ ID NO: 10 - DNA, 28 bp, Escherichia coli
gcggccgcaccactttgtacaagaaagc

SEQ ID NO: 11 - DNA, 40 bp, Aspergillus terreus
acaaaaaagcaggctccacaatggagagtgcagagctgtc

SEQ ID NO: 12 - DNA, 35 bp, Aspergillus terreus
acaagaaagctgggtctaaacgggcctatctagta

SEQ ID NO: 13 - DNA, 40 bp, Saccharomyces cerevisiae
acaaaaaagcaggctccacaatgttcgaatctgtcaattt

SEQ ID NO: 14 - DNA, 35 bp, Saccharomyces cerevisiae
acaagaaagctgggtctaccatgttaaaacgtctt

SEQ ID NO: 15 - DNA, 1365 bp, Fusarium solani
ggcgactctcccagcaatcctctagtttctgctccgacgtcgacatctccctctctagctcccatcgccgcgtctgctgctcccccagcatacgccgccagttcagcacctgtagctgcagccgatacgaccctcccgtccctcgccgccgccattgctggcacctcttcctcaacaccaccggataacccgaccgcctcgaccgcctccgcagctcttccctccgcacccgtgcccgccgccgaccacgacgtcaccgctgcctcatccgcaccgacatctacgccggcctcggctgctgctgtctctgctgccccgtccgcggtccctcagcagaacggcgacagcagggcttccgagggtgcttcgacgccctcgtccaatccggaaatgtccaaccagcacccaggagctccccatggccagcctgtgagctatccgggtccctcgacgccgtacgccacgacggttggcgcgaccaccgcccagtatgcttcttatcctgctgtgacgagccaacaacagatggacgcatatcgaccaaaccccatgcccgttgggagcaacgtcatgtcactaccgagcatgcgtacgatcgatccggtcccccaacaaccggggccgtccgtgacgaatcctcagggcatgcagatgagcatgcccatggcgcctgtgtcgggaggtttgccatactatggccaccatggaatgccgatggctgcgggttacgggatcccctcggaccccatgtctcgatacgctctcccgcacgatccgcgactgttgggacatagggggccaaaaaaggaaattaagcgtcggaccaagacaggatgtttaacctgccgaaagcgcaggatcaagtgcgacgagactcatcctacctgcaacaactgcaaaaagtcaaaacgcgagtgtctcggctacgatccgatctttcgacagcaaccgggtggtcaatcgtcgtcaaatattcagcctgcgccctcaagccaacgcactccacccgcgataccgagctctatcccctcgacgatcccctcgtcaatcgcgaccaacccaggcctacctgcacgggcgaccaactcctacggtagtcagccgtctatgctcccgagctcctacgctactgcacacgcgaccactgccagccccaacccgtccatcacgtcgctcagctacgagtccagcctctccactgtcgcgtctcctcccatcaagtccgagtccggatacgaatactcatcagcaatcgatccggcactgcaaagcctagcttcatcagcgatccaggacggctcaagaccagttgaccaaaagcctctggacaacaacctgcatctcagaggtggcgccccctacttt

SEQ ID NO: 16 - protein, 455 aa, Fusarium solani
GDSPSNPLVSAPTSTSPSLAPIAASAAPPAYAASSAPVAAADTTLPSLAAAIAGTSSSTPPDNPTASTASAALPSAPVPAADHDVTAASSAPTSTPASAAAVSAAPSAVPQQNGDSRASEGASTPSSNPEMSNQHPGAPHGQPVSYPGPSTPYATTVGATTAQYASYPAVTSQQQMDAYRPNPMPVGSNVMSLPSMRTIDPVPQQPGPSVTNPQGMQMSMPMAPVSGGLPYYGHHGMPMAAGYGIPSDPMSRYALPHDPRLLGHRGPKKEIKRRTKTGCLTCRKRRIKCDETHPTCNNCKKSKRECLGYDPIFRQQPGGQSSSNIQPAPSSQRTPPAIPSSIPSTIPSSIATNPGLPARATNSYGSQPSMLPSSYATAHATTASPNPSITSLSYESSLSTVASPPIKSESGYEYSSAIDPALQSLASSAIQDGSRPVDQKPLDNNLHLRGGAPYF

SEQ ID NO: 17 - DNA, 1551 bp, Candida albicans
atgtctgacgatcattcaatccattctcatacacagggacttcaccacatcaaaaagaaacgggtcgggaaagcgtgcgattcgtgccggatcaaaaaaaccaagtgtgacggtaaaaaaccttgcaacagatgtacattagacaacaagatttgtgtgttcacggaaaagaaaaaaaccaaagagaagaaacatccatctggttatgttgagcttttagaagcaagattagatatattaactagactgttggaaaaactaattgaattatcacgaccacatttacaatttattgacgatataattaccgaagaaaaactggtcgatcaagaaaaatcttctcctgcttcatcaacaccaaattcatcttctagtgaccaccatgacgatgttgaagaacagaattctactggtgtggttgctcctataaacaaagtagtctcatatctaattaaagaacaaggtctattgaaaaatataccccttgagtgggaacaagggactgagattgctgctaatttcgaccccaatagaaatttaaaactgtcgtcaagattatttgctgaacataaaggtgaagcttttattgggtcaccagtaacgtctcctcaacaaatgccaactagtaacccttttagaagaacctcaatgtttaaagaagaattggaatcaccttctagtgatcattacaatgaactgatattttcccaatcagtcgatgaaccttatatcaagaaggagcccaactcggctcagttttcaaaagggacattttctccacaacaacaacaactacagcaacagcagcaaatgttaaatcagttttccctcaatacttcccgtgatatatcagacatcgaaagtgattcatcaaacaaggaagatggattgaattctggttcggtatctccaccaacatccaactataggtcattttcattgttctctgatagtaatggtgaaccaatattgggcaaaacctcatcattgacgtcattaactaacaagtatgaaaatcattcactttcttcaccacaaaccgccataaacccagtattcaataattcaaccactggtccaatccttaccacattgagacgcaattcatcttcacattctcaaaagacccttggatctatacaacttcaacaaaaacctagaggaagtgttcataaaccagtgcgtaatcattctagagtttcgtcatttgataaacgaatggagtctacagctacagctgcggctactgtcgctgctgtttccggttcagtccaactactgcaaaatacaactccacagaatcttcctcatttggataatagtcaaaacaataattatttaagagacaatggtatgaataatattggtgctggcagtgttggtggtggtttgacttttggtgcacccagttttacacaaccattaagtccatctgatgatgctattgtttatcctacaaatcaatttactaatagaccagctacggtgtccacttttggtggtgggttagatgtgttggtggataattcattggatcctttcttcaatatt

SEQ ID NO: 18 - protein, 517 aa, Candida albicans
MSDDHSIHSHTQGLHHIKKKRVGKACDSCRIKKTKCDGKKPCNRCTLDNKICVFTEKKKTKEKKHPSGYVELLEARLDILTRSLEKLIELSRPHLQFIDDIITEEKSVDQEKSSPASSTPNSSSSDHHDDVEEQNSTGVVAPINKVVSYLIKEQGLLKNIPLEWEQGTEIAANFDPNRNLKSSSRLFAEHKGEAFIGSPVTSPQQMPTSNPFRRTSMFKEELESPSSDHYNESIFSQSVDEPYIKKEPNSAQFSKGTFSPQQQQLQQQQQMLNQFSLNTSRDISDIESDSSNKEDGLNSGSVSPPTSNYRSFSLFSDSNGEPILGKTSSLTSLTNKYENHSLSSPQTAINPVFNNSTTGPILTTLRRNSSSHSQKTLGSIQLQQKPRGSVHKPVRNHSRVSSFDKRMESTATAAATVAAVSGSVQLSQNTTPQNLPHLDNSQNNNYLRDNGMNNIGAGSVGGGLTFGAPSFTQPLSPSDDAIVYPTNQFTNRPATVSTFGGGLDVLVDNSLDPFFNI

SEQ ID NO: 19 - DNA, 2595 bp, Neurospora crassa
atgcccggcattctacccatgaaagttatcaaggtgggcaatagctcacaaagtcgcatcgcccaggcttgcgaccgctgccgcagcaaaaaaatccgctgcgacgggatccggccgtgttgttcacaatgcgccaatgttgggttcgagtgcaagactagcgataagctcagtaggcgcgctttccccagaggctacacagaatcgctcgaggagcgagtacgagcgttggaggcggaaatccgggaactcaaggacttgctggatgagaaggacgagaagctcgatatgctctccaagatgcacagcaatcgcagccgatctgccgagccacctcgaagcactccggcagcagagataaagagggattccggcacaccggcaaaagaggatactttccgcgtccaagcatcgcccttgggcgcctctaaaggccgctcctttatcgaaacattcaagcgtaaaatccaagagaacggcaagtcctgcaccgacttcaacccagaggccttcttacacattcagggatgttatcctctttcgacaaagctggcccctcagagtatgaggataccgcctcggctgtctcctgatcgctgcgtgaatgtctacttccaagaatgggcgccattatttccggttctccacaagcccgctttccttcgtgtctacgaggaattcgtcgcggatcctgaaaagatcaagaacaaccacaagctcacacagctttacttggtctttagcattgccggcctgtccagtgagcagcctgactttcagcagctggccgcttgcgagacacaatggcacaagtctttggaggctgtcttgatggacaacaccatgcttaccctccaatgcctcatccttgctttgatgtactgcactgtccgggccgactataagcggctgcaatactacaagggcattgctgtgggactttctcaccgcttaggtttacatcaaagccagaagcgcttctcattcggcgccctgactatcgagacacgaaagaaggtgttctggactctgtacacacttgactgcttttctgccgctatccttggtctcccaaagcttctcaaggatgaagacgtccacgccgagttcccatcagacaccgacgacgaaaatgtcacagagaagggatttcagccaagccttcccggcgaacctaccaggatctccagcgcacttgccttgttccgaggatcccggatcctaggcaaggtccttgagaagatctacccggctgccacttcgtacgagctgtcgctacaccagatgtcatcacttgagggagaactcaccgagtggtttgagaacctaccgcagcacttgaagctcaacttcaagcaggacaagccctcgaccgatgtgacaggcagcaggtctcctcttcttgccctcgcctattattatactcgaatccttatctatcggccggctattgcacctagcctgggccctaaggctgctcctgcactcatgtctgtcgccgagtccagtaagagcatcgtgcaaatagttcagctgctggaagagaggtccatgtccttctccttctgcctgaataaggcagacatcttgatcgtctgcggtatggcgttgctctaccagacactgggactcaagcacgacagcaaagtgttgaaggataacgagaaactggtcaacagcgttgttaagattgttaccaaggtgaacgctccaggatcgtacgattttaagaggatcgctggaatgctggttaccgtcgaggaatcgcttccccagtccttgccgacacccccgagacagtctcctgaggcgtgtatgcccacaccaccggcgcagcaaggatctccttcaccttcagctgttgatcgcggtgctcaaccaaaccttgctcgtcaatctagcgctagcttgagcgagacagatctcatcgtgcagcgggacaagctacttgggatggctgtgactcctcagcaccaacaatatcaacatcagcaactacaacaacagcacaaaaatgaactaagtcgcgcccgttctcaaacgtcattcgataacttacgacaaaaagcgcaacaaatgcgaccccatcatcgccactctctgagtcatgcccaagtcgcccaagctgcgcttatgggacgtacatcgactggcacacagtcgaccccaaacttggattatctttcattaagttcacctcagtcacccgtttccccggtacagatgcgcagtcaacctcatcagctccagcaacaacaacaacaacaaccacaaccacaacaacaacaacaacaacaccaacgctcttccatagcatcctctcactctcagcaaggccaaatgttcccgcagaagacatcaacaggcatgtcgacggctgagtgggaagcactggtaagatcgttggatggtggcccggtcagtctgtatactgcaatttacgggggtccagctttggcacccttggaaacgccttcgtctgctacacaatcgtcagccacggcatgggggcaagatccatgggacatgtcatcgtttaatcttggtgactttgtaccaggcgctccaacaagcacagaacgttctcagtttgag

SEQ ID NO: 20 - protein, 865 aa, Neurospora crassa
MPGILPMKVIKVGNSSQSRIAQACDRCRSKKIRCDGIRPCCSQCANVGFECKTSDKLSRRAFPRGYTESLEERVRALEAEIRELKDLLDEKDEKLDMLSKMHSNRSRSAEPPRSTPAAEIKRDSGTPAKEDTFRVQASPLGASKGRSFIETFKRKIQENGKSCTDFNPEAFLHIQGCYPLSTKLAPQSMRIPPRLSPDRCVNVYFQEWAPLFPVLHKPAFLRVYEEFVADPEKIKNNHKLTQLYLVFSIAGLSSEQPDFQQLAACETQWHKSLEAVLMDNTMLTLQCLILALMYCTVRADYKRLQYYKGIAVGLSHRLGLHQSQKRFSFGALTIETRKKVFWTLYTLDCFSAAILGLPKLLKDEDVHAEFPSDTDDENVTEKGFQPSLPGEPTRISSALALFRGSRILGKVLEKIYPAATSYELSLHQMSSLEGELTEWFENLPQHLKLNFKQDKPSTDVTGSRSPLLALAYYYTRILIYRPAIAPSLGPKAAPALMSVAESSKSIVQIVQLLEERSMSFSFCLNKADILIVCGMALLYQTLGLKHDSKVLKDNEKLVNSVVKIVTKVNAPGSYDFKRIAGMLVTVEESLPQSLPTPPRQSPEACMPTPPAQQGSPSPSAVDRGAQPNLARQSSASLSETDLIVQRDKLLGMAVTPQHQQYQHQQLQQQHKNELSRARSQTSFDNLRQKAQQMRPHHRHSLSHAQVAQAALMGRTSTGTQSTPNLDYLSLSSPQSPVSPVQMRSQPHQLQQQQQQQPQPQQQQQQHQRSSIASSHSQQGQMFPQKTSTGMSTAEWEALVRSLDGGPVSLYTAIYGGPALAPLETPSSATQSSATAWGQDPWDMSSFNLGDFVPGAPTSTERSQFE

SEQ ID NO: 21 - DNA, 1785 bp, Neurospora crassa
atggctctgaagaaaatgccgccaaagaagccttaccaccaaaaggcttcgaaaactaaggcatgctacaactgccatcggaaacgtcttcgctgtgacaagtcgctgcctgcctgtctcaagtgctccatcaacggcgaggaatgtcttggctacggcatcgtcctgcgttgggccgcctgtaattcaccaacctccaccataaccaccaggaccactaacaagaccaacttcaacggcaccaacaccaccacaccacgaaccgtcaaatcatctacgccaacacaagctccaacaccaagcgacagccctcgacaacttgataccgatgtcactagtagctcagcacccagccacacttgtagtaggagtactaccacgtctaccacaaccacccgcatctcatctccaaccctagaggaaaccatcgacagcttcacagtggagacaccaatcgataacaatgtcgaccctctaccgcgagcaccagatgataacccagatccaagctcacaaattatcaagcgccccgtcaacctcatcaagattccattaacagatccactcctcaacggtctctcaaccaaggcaagatggtacatgcatcatgttgccaccattgtctgtcgagacctggtctcaattgaccagaaggaacggaatccattccgggccatcatccctttggttcgcaagtttgactacctccagtcggtcgtcttagcaacggcagccatgcacttatctacgattcacaagtaccaaggtcgaagtctaccgtcggagtccgccctagtagacgcactgatgctcaagtcccgggcacttcaccttcttcgcgccgccatcaatgacaacaccctcacggacaaggccatgattctttccgccatcgtcttccttgtcaaacttgatctcatcgactccggccgaggaggctggaaagcccatgttggagccgcccggcgtctgatatcatccctatacctgaccaaggctcaccttgacggggccatcgcccccttagtcaacgccatcgccgccgactgtcttacctatcgcatatacggctcaaccatcagcggcaacacttcgtcgtggtcggacaataccatcgatgacggggtcgtgttgccgtacattttgcagaacgccgaggcctacagctaccattgcgcaccaccggctatcctccaaattattctctctgcaagccaactctgtagcggcagctccacgacgctggaaacagatggaggggcggggaggattgtcaccgcggcggcgttgcttcacaaggcgcgcaactttgacgtgcagacatgggtgtacaatatcaagggactgccaccggatgacgacctggaagcgcgggtaagcgtggcgtcagcacaccgcgcggcagcctgtctgttcgtcttgttgtcggttcccgagactggattgctcgagatacctctgctagagcccaaggatctggtgcaggaaattcttggacatttgtcctgcatcccagataatcacgtccacttgaaaggaacggtatggccgacttttgttgttggcgcagagacggacgatttgagtgagagggcttggtgcctggagcggttggtggcggtttggacaaagaatccttggacgtatccgtggggatacgtgcacacggcgatggagatgttgcaggaaatttggaggttgaaggatttggcagcgcagcagggcgatgatggaatcaactggttgcagaggttaaaagcgactgagaatagttgcttgattgta

SEQ ID NO: 22 - protein, 595 aa, Neurospora crassa
MALKKMPPKKPYHQKASKTKACYNCHRKRLRCDKSLPACLKCSINGEECLGYGIVLRWAACNSPTSTITTRTTNKTNFNGTNTTTPRTVKSSTPTQAPTPSDSPRQLDTDVTSSSAPSHTCSRSTTTSTTTTRISSPTLEETIDSFTVETPIDNNVDPLPRAPDDNPDPSSQIIKRPVNLIKIPLTDPLLNGLSTKARWYMHHVATIVCRDLVSIDQKERNPFRAIIPLVRKFDYLQSVVLATAAMHLSTIHKYQGRSLPSESALVDALMLKSRALHLLRAAINDNTLTDKAMILSAIVFLVKLDLIDSGRGGWKAHVGAARRLISSLYLTKAHLDGAIAPLVNAIAADCLTYRIYGSTISGNTSSWSDNTIDDGVVLPYILQNAEAYSYHCAPPAILQIILSASQLCSGSSTTLETDGGAGRIVTAAALLHKARNFDVQTWVYNIKGLPPDDDLEARVSVASAHRAAACLFVLLSVPETGLLEIPLLEPKDLVQEILGHLSCIPDNHVHLKGTVWPTFVVGAETDDLSERAWCLERLVAVWTKNPWTYPWGYVHTAMEMLQEIWRLKDLAAQQGDDGINWLQRLKATENSCLIV

SEQ ID NO: 23 - DNA, 1473 bp, Aspergillus parasiticus
atggtgaggcgacgggcttgcgatggatgctctctccgcaaaacccgttgcagcggcggacagccgtgtcaaccctgtgcccagtctggatttgaatgctcctatctcaaaccagcggcaaagcccggtccgaaaggtccacgcgctgaaacttacatacgtatcaacagacgcttgcagagcatgcgagatcgtgctccccgtggtgcaaccgaaaccgcatcacccgctaatataagagcaggcctggcggaggcaaccgactcatccagggtgataccagccgttgaagtcgccggtgccgaacagatgccgatcctgactgaatggccatcgcaactgccccttgcggatgtcttaggtcacttggaggcctacgagcataggatgtatcccgtctggcctgtcgttgacgttgctcgccttcgcgactcgctcatgctggacatgaacaatgttgagttacgctctttagcatttgcggtatgcgcagcgacctgcgctcagttgcagtgtcatcctgacaaccaggggacgcaaatgtttggcgtgggaacgtgcgctttggcggattattttgcgaaagaatcagagtattgccgcactatgtatgattaccgtgaaagcggcacgtttgaggcagttctagtgccgctgttccttcatttttactacggtgcgacgaacaagatggcgacggcttcgctcttgctccgagagtcggtgacgttgtgtcagcttcaggggttggatagcgaagatacatatcaagatatggccgttgaagaagatacgtataggcggagggcgttctggctcctctatgtgaccgaaagaggtcacgctattcagcatggaatcaatacctgtctaaaaaactccattcgactgccaacgcgcgattgttcagacgaactccacctcgttgaagcctttgacagccttgtcggtctatttatttccgtggaaggtgttcttctcggtcccggtggctcacctcgcggccccaataccattatatgcagtaaggacatgctctgtcggctacagagccaactccgccagcgcctgcagtggcctacggcataccatgcattgcagagaacggatatcgctattacccaacagtggctacgtgtgctactttggcagctgtctttgaagaatattttcctctcgagcgcttcagctgatgatagtatgaaattgacctacccggtccatgtggcaagagacgcgatagtgctcatttccaacgtgcccccaggatacatttatggcacatgcttactgaatccaggcaatcaaactcttcgaaatcacaagtaccctactggatgtgattcactgtgttccctcccttgtgcaccgcaacccagctgggacatacgacattctccaccatttatgttatttactgtcatctctgagccaccgaccatttggactagagttactgcagaagaaattaga

SEQ ID NO: 24 - protein, 491 aa, Aspergillus parasiticus
MVRRRACDGCSLRKTRCSGGQPCQPCAQSGFECSYLKPAAKPGPKGPRAETYIRINRRLQSMRDRAPRGATETASPANIRAGLAEATDSSRVIPAVEVAGAEQMPILTEWPSQLPLADVLGHLEAYEHRMYPVWPVVDVARLRDSLMLDMNNVELRSLAFAVCAATCAQLQCHPDNQGTQMFGVGTCALADYFAKESEYCRTMYDYRESGTFEAVLVPLFLHFYYGATNKMATASLLLRESVTLCQLQGLDSEDTYQDMAVEEDTYRRRAFWLLYVTERGHAIQHGINTCLKNSIRLPTRDCSDELHLVEAFDSLVGLFISVEGVLLGPGGSPRGPNTIICSKDMLCRLQSQLRQRLQWPTAYHALQRTDIAITQQWLRVLLWQLSLKNIFLSSASADDSMKLTYPVHVARDAIVLISNVPPGYIYGTCLLNPGNQTLRNHKYPTGCDSLCSLPCAPQPSWDIRHSPPFMLFTVISEPPTIWTRVTAEEIR

SEQ ID NO: 25 - DNA, 2922 bp, Pyricularia grisea
atgttttgtgcatactgtggacagaagtttactcgcaaggagcatctagaaaggcacattccgacccatacgaatgtgaaacctcacagatgtacagcctgcggcatctcattcggccggagcagggacctgctcacgaggcactaccaagcataccacgaagccagagatccaatggagccgataccagggagcgcaccgccagttgcgggacgcacgccgattgcttgccaaaactgcgcaaacgcaaagacggggtgcgacaagagggtgccatgctcgagatgtgctgagaagaacctcgactgcgcggcaaggtacgcgcggaggtcttcgaaagccgctgttcgggcggcgcaggcgagcgcagcctttcacaacagccaaataccaaatccgacgacgaccatgcaccaccagccgcacccacaccaccacaatcacgtacaggtagtcaaccccgccatgatggagatcgaccctgtcatgcccaagcaggaatctttggtccagaccccggaaggggtggaaccacaagcactcatggagacttctcgccttcacaccagcccgcagcaaaaatcgccattgacttcacaccatcaaagtcccttagagtttccgtcaccgcaccctcgacaggaaggaatggaagactttatgcacctcagcaccgaatttcctggcacagaatctcactacaacgacctaatgatatggcccgactatcctttggacctcgaaatgtaccccagccaaattccaatgacccgaccagatctggccgtgcagccctttgctgatctgggaagcgagatctcatcaacttcggaacccatggcaacatcatcctcgcgaggttccacacacacacgcgggactagcattttgtcgtcggcagaattcgagacttcaatgaagccagccgatctagcagcagccatcaacacccccgccggcagctcaatagcagagttcgaggttgtcatagccgccgaggcagcgtggccattagcaagatgcaacccacccatttattccaacacgtgtccacgaacagcaattgtacacctagagtgtctcgaacagaaatccaaggtggagggaacctggagctcgttggaaaagtacatggagcaagtcgactgggatgcggcagatctgtcctctgtagtgcccatcacctctaggacgcgggataagatgcttgccatcacgcaggggtttttgcacaaggcacttgacattcaccgcgggggcatcactggtttctccaaccagggtcaccaccgccctggtgactttaactttatcgtcctgccccccaccaagatcctcgagtatttcctgcgcagctacattcgcactctttccccgtattactcactctccctcggcagctgtgtcgatccaaatgagatgctgcgcgacaaccatgcttccactctgttggtgcttctcatgattgcccaaggcgcagcagccgtgccaatggccgaggcgcgctacctctcaaccggcttggtagaaacttgccgcatctcgctctttgacattattgagaagaatgtcgaattgtcagccgaccccacagcgctcaggtgtgcccttctctttacgttgctcggagcatggagcggcgacaagtggctcatggatatctcaatgggccaaaggggcatgtatatgtccatggtcaagcatgctggcatgatggactctcagccgcccatgattccagtctttacaaactcaaccagcactgagttggagtggagggcctggtgccaccgcgaatctcagaatagacttgtgtacaattgggtaatgatggatcaggagcttagtctcttccatgacaccgctcccttgatttcgataagcgaccttttgtgcccgctcccaggacctgacgagctttggacggcgcccaactccgaggtctggctatcgtcggtccagtccctctacggtggcaacaacgtcaacgtcaacccgcaactactatccacgccatctcctaccccgtcgctatccgatctgttccagaacttcttacatgataacttgacgcctggcaagaacagcctttcaccacaacaccttcggcttttactacacccattacagtcactcctctgccacctgaggcagatgctgtcatgctttcccgacatcccatcgacgcgacgcaccacaactcgtaccgtcactagggcctctacgctttccaggcttgaggaggtgcaggccttgttgcaaaagtggtatgagctgtcgatggaattctcaaaggagagccccgactgtcccatcacccgctgcaacatggtactctatcatctcatctccctcaatgccgtgacaaacttcccagaggtggagcgcctcgcccgtcgcgagggctttgacgggtcctactgggagttgtccatgcgccacaagatgtgcatctaccagcgggaggaagccgtgttccactgcggacaggtcctcaggcttgttcgatcgatgccccaggaccgccgaccagtgtggtggagcgcggctgtataccgtgccgtcctgatcctgtgggccgactcgatggccaggctagatcccaccctcaagcgcgaggacacggtcggaccctcgtcgacccccgccgctgctgccaccccagggcctctagtccccgttgaccaagtgactcccgagaacccagcggtgattgcttacctctggaacagggagggcgttgcgctccttaccagaaacgacgggagatccgtgagcctcgacaacccagcagaggtgcttgcttacggagtcaaggagattgaagaggccgtgagcatacgcttcagcgacgggatcaaaagaaagctcgccgccttggcccaaaactggagtgtcggttcgcccttggctgggtcttca

SEQ ID NO: 26 - protein, 974 aa, Pyricularia grisea
MFCAYCGQKFTRKEHLERHIPTHTNVKPHRCTACGISFGRSRDLLTRHYQAYHEARDPMEPIPGSAPPVAGRTPIACQNCANAKTGCDKRVPCSRCAEKNLDCAARYARRSSKAAVRAAQASAAFHNSQIPNPTTTMHHQPHPHHHNHVQVVNPAMMEIDPVMPKQESLVQTPEGVEPQALMETSRLHTSPQQKSPLTSHHQSPLEFPSPHPRQEGMEDFMHLSTEFPGTESHYNDLMIWPDYPLDLEMYPSQIPMTRPDLAVQPFADLGSEISSTSEPMATSSSRGSTHTRGTSILSSAEFETSMKPADLAAAINTPAGSSIAEFEVVIAAEAAWPLARCNPPIYSNTCPRTAIVHLECLEQKSKVEGTWSSLEKYMEQVDWDAADLSSVVPITSRTRDKMLAITQGFLHKALDIHRGGITGFSNQGHHRPGDFNFIVLPPTKILEYFLRSYIRTLSPYYSLSLGSCVDPNEMLRDNHASTLLVLLMIAQGAAAVPMAEARYLSTGLVETCRISLFDIIEKNVELSADPTALRCALLFTLLGAWSGDKWLMDISMGQRGMYMSMVKHAGMMDSQPPMIPVFTNSTSTELEWRAWCHRESQNRLVYNWVMMDQELSLFHDTAPLISISDLLCPLPGPDELWTAPNSEVWLSSVQSLYGGNNVNVNPQLLSTPSPTPSLSDLFQNFLHDNLTPGKNSLSPQHLRLLLHPLQSLLCHLRQMLSCFPDIPSTRRTTTRTVTRASTLSRLEEVQALLQKWYELSMEFSKESPDCPITRCNMVLYHLISLNAVTNFPEVERLARREGFDGSYWELSMRHKMCIYQREEAVFHCGQVLRLVRSMPQDRRPVWWSAAVYRAVLILWADSMARLDPTLKREDTVGPSSTPAAAATPGPLVPVDQVTPENPAVIAYLWNREGVALLTRNDGRSVSLDNPAEVLAYGVKEIEEAVSIRFSDGIKRKLAALAQNWSVGSPLAGSS

SEQ ID NO: 27 - DNA, 1311 bp, Aspergillus flavus
atggttgaccatatctccccccgggcatctcccggaccgatccgttcctcccagactcgccgcgcccgaaagctccgggatagctgtacgagttgtgccagctcaaaagtgcgatgcaccaaggagaaaccggcctgtgctcggtgtatcgaacgtggtcttgcctgtcaatacatggtctccaagcggatgggccgcaatccgcgcgctcccagtccccttgattcaactcggcgaccatcagagagtcttccttcagccaggtcggaacagggacttccggcgcataacacgtactcaacgcctcatgctcatacgcaggcccacactcatgctcattctcatccgcaaccgcatccacaatctcatcctcaatcgaatcaaccaccacacgctctgcccacccccaatggtagcagtagcgtctccgccatcttttctcatcagagtccgccgccacccgtggagacccagggccttggaggagatctggctggtcaggagcaaagcaccctgtcttccctaacagtcgattcggaattcgggggctctttgcagtcaatggaacacggaaaccatgtcgatttcttggccgagtcgacggggagtcttttcgacgcgtttttggaagtagggacccccatgatcgacccgttcctcgagtcggccccactaccaccgtttcaggcgcgctattgctgcttttcgctagcactacaaacactgacccacctcttcccccacgccccgctgggctgtcaactacggctgacggacggtgaggacagttcgtgcaacctgatgacgactgatatggtcatctcggggaacaagagggctaccgatgcggtccggaagatcctcgggtgttcgtgcgcgcaggatggctacttgctgagcatggtcgtccttatcgttctcaaggtgctggcatggtatgctgcggcagcaggcacccagtgtacctcaacggcggcgggtggagaaaccaacagtggcagctgtagcaacagtcccgccaccgtgtccagtggctgtctgacggaagagcgcgtgctgcacctccctagtatgatgggcgaggattgtgtggatgaggaagaccagccgcgagtggcggcacagcttgttctgagtgaactgcaccgagtccagtcgctggtgaacctattggccaagcgcctgcaagaaggtggagacgatgcagcagggataccggcgcaccatccagcgtcccctttctcactactcgggtttagtggcctcgaagcaaatctcgccaccgcttggcgccgtgtcctccgacattat

SEQ ID NO: 28 - protein, 437 aa, Aspergillus flavus
MVDHISPRASPGPIRSSQTRRARKLRDSCTSCASSKVRCTKEKPACARCIERGLACQYMVSKRMGRNPRAPSPLDSTRRPSESLPSARSEQGLPAHNTYSTPHAHTQAHTHAHSHPQPHPQSHPQSNQPPHALPTPNGSSSVSAIFSHQSPPPPVETQGLGGDLAGQEQSTLSSLTVDSEFGGSLQSMEHGNHVDFLAESTGSLFDAFLEVGTPMIDPFLESAPLPPFQARYCCFSLALQTLTHLFPHAPLGCQLRLTDGEDSSCNLMTTDMVISGNKRATDAVRKILGCSCAQDGYLLSMVVLIVLKVLAWYAAAAGTQCTSTAAGGETNSGSCSNSPATVSSGCLTEERVLHLPSMMGEDCVDEEDQPRVAAQLVLSELHRVQSLVNLLAKRLQEGGDDAAGIPAHHPASPFSLLGFSGLEANLATAWRRVLRHY

SEQ ID NO: 29 - DNA, 1299 bp, Aspergillus nidulans
atggagcccccagcgatcagccagcaatccacacccacggccccggggggaacgcaagggacacgcaaactgcgcgagagttgcatctcgtgctccagatccaaggtcaagtgcaataaggagaagcccacatgcagtcgatgcgtccgccgtggtctgccttgcgagtatatggtttccaggcgcactggacgcactcgcgtcattggtgttgagcagccaaagacagcaccatcaccaacaacaccgacgaatacgacagcagctactacagcaacgaaggcaggaccaccagttacaacagacagtgctgttcatacacctgtcattactacggcgccctctcccaagccggtgcagatccagtctcctccagccgaaccagatctctggggcgccatcctgtctccgaatacttccacctccaccgacctatcgtcactcctctcggtgaatacaaatttcagtcagctcttcgcctcgctttctccttcgcttcttgagggtatggatggcatggatgccgaaatgcacgcgccggagctgggcgcattgtcggtcgccgacccatcgtcctccatgatgcaggggttagaggcccctaacgctgcccaaccaccgtcttcgaacaccacaagccactcctactgcctgtccatctgcctggatactctcatgcggctctttccgaatgctggcgctaactgcgagcgacccgggcacgagagcaaccccggcaaactgttcactatcgagtccgttattgaggacaacaaacaaatcttggacacagcgcagacaatcctggcttgccgctgcgccgaggatgagtacgtggtcactctcgtctcacttattgtcttcaaggttcttggatggtacgtcgccgcggctcgggataggtcgtcggacccggggcgcgaagaagacttcaactggtcgactgcccaagacagtcgtagaggttcggtctcttcctttgaggagcaggtgctgcatcttcccaccgtcgtcggcacttattgcattgatggccatcatcagagccgcatggcagcccagctggtgctgagcgagctataccgcgtccaacgactggtgactcaggtaagccgtcgcctagaatctattcgccgccgctcctcgagcagctcgagctctgcctctagtaatacaacggactctgacggcgggatgtcgacccccttgtcgtcgaccaccctggtccatctagaagacgatttgcgcaagcgcctgcgtgccgtctcaagcgaaacgatcagcatcctccgccacgcc

SEQ ID NO: 30 - protein, 433 aa, Aspergillus nidulans
MEPPAISQQSTPTAPGGTQGTRKLRESCISCSRSKVKCNKEKPTCSRCVRRGLPCEYMVSRRTGRTRVIGVEQPKTAPSPTTPTNTTAATTATKAGPPVTTDSAVHTPVITTAPSPKPVQIQSPPAEPDLWGAILSPNTSTSTDLSSLLSVNTNFSQLFASLSPSLLEGMDGMDAEMHAPELGALSVADPSSSMMQGLEAPNAAQPPSSNTTSHSYCLSICLDTLMRLFPNAGANCERPGHESNPGKLFTIESVIEDNKQILDTAQTILACRCAEDEYVVTLVSLIVFKVLGWYVAAARDRSSDPGREEDFNWSTAQDSRRGSVSSFEEQVLHLPTVVGTYCIDGHHQSRMAAQLVLSELYRVQRLVTQVSRRLESIRRRSSSSSSSASSNTTDSDGGMSTPLSSTTLVHLEDDLRKRLRAVSSETISILRHA

SEQ ID NO: 31 - DNA, 1152 bp, Aspergillus oryzae
atggttgaccatatctccccccgggcatctcccggaccgatccgttcctcccagactcgccgcgcccgaaagctccgggatagctgtacgagttgtgccagttcaaaagtgcgatgcaccaaggagaaaccggcctgtgctcggtgtatcgaacgtggtcttgcctgtcaatacatggtctccaagcggatgggccgcaatccgcgcgctcccagtccccttgattcaactcggcgaccatcagagagtcttccttcagccgggtcggaacagggacttccggcgcacaacacgtactcaacgcctcatgctcatacccaggcccacactcatgctcatgctcattctcatccgcaaccgcatccacaatctcatcctcaatcgaatcaaccaccacacgctctgcccacccccaatggtagcagtagcgtctccgccatcttttctcaccagagtcccccgccactcgtggagacccagggccttggaggagatctggctggtcaggcgcaaagcaccctgtcttccctaacagtcgattcggaattcgggggctctttgcagtcaatggaacacggaaaccatgccgatttcttggcggagtcgacggggagtcttttcgacgcgtttttggaagtggggacccccatgatcgacccgttcctcgagtcggccccactgccaccgtttcaggcgcgctattgctgcttttcgctagcactacaaacactgacctgcctcttcccccacgccccgctgggctgtcagctgcggctgacggacggtgaggacagttcgtgcaacctgatgacgactgatatggtcatctcggggaacaagaaggctaccgatgcggtccggaagatcctcgggtgttcgtgcgcgcaggatggctacttgctgagcatggtcgtccttatcgttctcaaggtgctggggtggtatgctgcggcagcaggcacccagtgtacctcaacggcggcgggtggagaaaccaacagtggcagctgtagcaacagtcccgccaccgtgtccagtggctgtctgacggaagagcgcgtgctgcaccaccctagtatggtgggcgaggattgtgtggatgaagaagaccagccgcgagtggcggcacagcttgttctgagcgaactgcac

SEQ ID NO: 32 - protein, 384 aa, Aspergillus oryzae
MVDHISPRASPGPIRSSQTRRARKLRDSCTSCASSKVRCTKEKPACARCIERGLACQYMVSKRMGRNPRAPSPLDSTRRPSESLPSAGSEQGLPAHNTYSTPHAHTQAHTHAHAHSHPQPHPQSHPQSNQPPHALPTPNGSSSVSAIFSHQSPPPLVETQGLGGDLAGQAQSTLSSLTVDSEFGGSLQSMEHGNHADFLAESTGSLFDAFLEVGTPMIDPFLESAPLPPFQARYCCFSLALQTLTCLFPHAPLGCQLRLTDGEDSSCNLMTTDMVISGNKKATDAVRKILGCSCAQDGYLLSMVVLIVLKVLGWYAAAAGTQCTSTAAGGETNSGSCSNSPATVSSGCLTEERVLHHPSMVGEDCVDEEDQPRVAAQLVLSELH

SEQ ID NO: 33 - DNA, 1332 bp, Aspergillus parasiticus
atggttgtccatatctccccccgggcatctcccggaccgatccgttcctcccagaccccccgcgcccgaaagctccgggatagctgtacgagttgtgccagttcaaaagtgcgatgcaccaaggagaaaccggcctgtgctcggtgtatcgaacgtggtcttgcctgtcaatacatggtctccaagcggatgggccgcaatccgcgcgctcccagtccccttgattcaacttggcgaccatcagagagtcttccttcagccgggtcggaacagggacttccggcgcataacacgtactcaacacctcatgctcatacccaggcccacactcatgctcatgtttatccgcaaccgcatccacaatctcatcctcaatcgaatcaaccaccacacgctctgcccacccccaatagtagcagtagcgtctccgccatattttctcatcagagtcccccgccacccgtggagacccagggccatggaggagatctggctggtcaggagcaaagcaccctgtcttccctaacaatcgattcggaattcgggggctctttgcagtcaatagaacacggaaaccatgccgatttcttggctgagtcgacggggagtcttttcgacgcgtttttggaagtggggacccccatgatcgacccgttcctcgagtcggccccactgccaccgtttcaggcgcgctattcctgcttttcgctagcactacaaacactgacccacctcttcccccacgccccgctgggctgtcagctgcggctgacggacggtgaggacagttcgtgcaacctgatgacgactgatatggtcatctcggcgaacaagaaggctaccgatgcggtccggaagatcctcgggtgttcgtgcgcgcaggatggctacctgctgagcatggtcgtccttatcgttctcaagatgctggcgtggtatgctgcggcagcaggcacccagtgtacctcaacggcggcgggtggagaaaccaacagtggcagctgtagcaacagtcccgccaccatgtccactagctgtctgacggaagagcgtgtgctgcacctccctagtatggtgggcgaggattgtgtggatgaggaagaccagccgcgagtggcggcacagcttgttctgagcgaactgcaccgagtccagtcgctggtgaacctattggccaagcgcctgcaagaaggtggagatgatgcagcagggataccggcgcaccatccaacgtcccctttctcactactcgggtttagcggcctcgaagcaaatctccgccaccgcttgcgcgccgtgtcctccgacattattaattacctgcatcgagaa

SEQ ID NO: 34 - protein, 444 aa, Aspergilluls parasiticus
MVDHISPRASPGPIRSSQTRRARKLRDSCTSCASSKVRCTKEKPACARCIERGLACQYMVSKRMGRNPRAPSPLDSTRRPSESLPSAGSEQGLPAHNTYSTPHAHTQAHTHAHSHPQPHPQSHPQSNQPPHALPTPNGSSSVSAIFSHQSPPPLVETQGLGGDLAGQAQSTLSSLTVDSEFGGSLQSMEHGNHADFLAESTGSLFDAFLEVGTPMIDPFLESAPLPPFQARYCCFSLALQTLTCLFPHAPLGCQLRLTDGEDSSCNLMTTDMVISGNKKATDAVRKILGCSCAQDGYLLSMVVLIVLKVLGWYAAAAGTQCTSTAAGGETNSGSCSNSPATVSSGCLTEERVLHHPSMVGEDCVDEEDQPRVAAQLVLSELHRVQSLVNLLAKRLQEGGDDAAGIPAHHPASPFSLLGFSGLEANLRHRLRAVSSDIIDYLHRE

SEQ ID NO: 35 - DNA, 2463 bp, Aspergillus nidulans
atggcagatacgcgccgacgccagaatcatagctgcgatccctgtcgcaagggcaagcgacgctgtgatgccccggaaaatagaaacgaggccaatgaaaacggctgggtttcgtgttcaaattgcaagcgttggaacaaggattgtaccttcaattggctctcatcccaacgctccaaggcaaaaggggctgcacctagagcgagaacaaagaaagccaggaccgcaacaaccaccagtgaaccatcaacttcagctgcaacaatccctacaccggaaagtgacaatcacgatgcgcctccagtcataaactctcacgacgcgctcccgagctggactcaggggctactctcccaccccggcgaccttttcgatttcagccactctgctattcccgcaaatgcagaagatgcggccaacgtgcagtcagacgcaccttttccgtgggatctagccatccccggtgatttcagcatgggccaacagctcgagaaacctctcagtccgctcagttttcaagcagtccttcttccgccccatagcccgaacacggatgacctcattcgcgagctggaagagcagactacggatccggactcggttaccgatactaatagtgtacaacaggtcgctcaagatggatcgctatggtctgatcggcagtcgccgctactgcctgagaacagtctgtgcatggcctcagacagcacagcacggcgatatgcccgttccacaatgacgaagaatctgatgcgaatctaccacgatagtatggagaatgcactgtcctgctggctgacagagcacaattgtccatactccgaccagatcagctacctgccgcccaagcagcgggcggaatggggcccgaactggtcaaacaggatgtgcatccgggtgtgccggctagatcgcgtatctacctcattacgcgggcgcgccctgagtgcggaagaggacaaagccgcagcccgagccctgcatctggcgatcgtagcttttgcgtcgcaatggacgcagcatgcgcagaggggggctgggctaaatgttcctgcagacatagccgccgatgagaggtccatccggaggaacgcctggaatgaagcacgccatgccttgcagcacacgacagggattccatcattccgggttatatttgcgaatatcatcttttctctcacgcagagtgtgctggatgatgatgagcagcacggtatgggtgcacgtctagacaagctactcgaaaatgacggtgcgcccgtgttcctggaaaccgcgaaccgtcagctttatacattccgacataagtttgcacgaatgcaacgccgcggtaaggctttcaacaggctcccgggaggatctgtcgcatcgacattcgccggtattttcgagacaccgacgccgtcgtctgaaagcccacagcttgacccggttgtggccagtgaggagcatcgcagtacattaagccttatgttctggctagggatcatgttcgatacactaagcgctgcaatgtaccagcgaccactcgtggtgtcagatgaggatagccagatatcatcggcatctccaccaaggcgcggcgctgaaacgccgatcaacctagactgctgggagcccccgagacaggtcccgagcaatcaagaaaagagcgacgtatggggcgacctcttcctccgcacctcggactctctcccagatcacgaatcccacacacaaatctctcagccagcggctcgatggccctgcacctacgaacaggccgccgccgctctctcctctgcaacgcccgtcaaagtcctcctctaccgccgcgtcacgcagctccaaaccctcctctatcgcggcgccagccctgcccgccttgaagcggccatccagagaacgctctacgtttataatcactggacagcgaagtaccaaccatttatgcaggactgcgttgctaaccacgagctcctcccttcgcgcatccagtcttggtacgtcattctagacggtcactggcatctagccgcgatgttgctagcggacgttttggagagcatcgaccgcgattcgtactctgatatcaaccacatcgaccttgtaacaaagctaaggctcgataatgcactagcagttagtgcccttgcgcgctcttcactccgaggccaggagctggacccgggcaaagcatctccgatgtatcgccatttccatgattctctgaccgaggtggcattcctggtagaaccgtggaccgtcgttcttattcactcgtttgccaaagctgcgtatatcttgctggactgtttagatctggacggccaaggaaatgcactagcggggtacctgcagctgcggcaaaattgcaactactgcattcgggcgctgcaatttctgggcaggaagtcggatatggcggcgctggttgcgaaggatttagagagaggtttgaatgggaaagttgacagctttttg

SEQ ID NO: 36 - protein, 821 aa, Aspergillus nidulans
MADTRRRQNHSCDPCRKGKRRCDAPENRNEANENGWVSCSNCKRWNKDCTFNWLSSQRSKAKGAAPRARTKKARTATTTSEPSTSAATIPTPESDNHDAPPVINSHDALPSWTQGLLSHPGDLFDFSHSAIPANAEDAANVQSDAPFPWDLAIPGDFSMGQQLEKPLSPLSFQAVLLPPHSPNTDDLIRELEEQTTDPDSVTDTNSVQQVAQDGSLWSDRQSPLLPENSLCMASDSTARRYARSTMTKNLMRIYHDSMENALSCWLTEHNCPYSDQISYLPPKQRAEWGPNWSNRMCIRVCRLDRVSTSLRGRALSAEEDKAAARALHLAIVAFASQWTQHAQRGAGLNVPADIAADERSIRRNAWNEARHALQHTTGIPSFRVIFANIIFSLTQSVLDDDEQHGMGARLDKLLENDGAPVFLETANRQLYTFRHKFARMQRRGKAFNRLPGGSVASTFAGIFETPTPSSESPQLDPVVASEEHRSTLSLMFWLGIMFDTLSAAMYQRPLVVSDEDSQISSASPPRRGAETPINLDCWEPPRQVPSNQEKSDVWGDLFLRTSDSLPDHESHTQISQPAARWPCTYEQAAAALSSATPVKVLLYRRVTQLQTLLYRGASPARLEAAIQRTLYVYNHWTAKYQPFMQDCVANHELLPSRIQSWYVILDGHWHLAAMLLADVLESIDRDSYSDINHIDLVTKLRLDNALAVSALARSSLRGQELDPGKASPMYRHFHDSLTEVAFLVEPWTVVLIHSFAKAAYILLDCLDLDGQGNALAGYLQLRQNCNYCIRALQFLGRKSDMAALVAKDLERGLNGKVDSFL

SEQ ID NO: 37 - DNA, 2295 bp, Aspergillus nidulans
atgtcctccacagcgcatccgacgaaccttgcaccctcaggaaatggctcagctgcctgcgtccactgtcatcgtcgtaaagtacgatgcgacgctcgtctggtagggctaccatgtagcaattgtcgttcggcggggaagaccgactgtcaaatccatgaaaaaaagaaaaaactggcggtgcgctcgatactggacccagttccgatccgttgtcggccccctaaccctgaagaagcgccgaagccgatatcttcgctatcaccgtcatcagagcctcccaatgctttcacaactgcactccgcgctgttcagtcggatatcacagctccgtctggggttgcgaaccgtgtcgcacatatccgaagccgtagttctcagtacgataccaaaggtaccagatccaataataactcgggtaacaatactcaatatcaaaatgttctgccggagccggattccccgccctatagccgccccgcggcctcagatccgtcggagggagagtcgcgtgcggatattgagaaacggttggtgaatctgattgacggggaagcttcggatagtcgggcgattcaaagaggtgtacgagcaatatacgttgggcacgagctctcgaatatgtctttcttgatccgccaacaacgtgacacgggtgacgatgtataccacttcgcgggaaacgagatacctcggcggcagctacgaactggccatgatcagctactcatggatgctctcacgttacctgagcctgcccttgccgatgagctcgtgcatgcatatttcgcacaagtcaatccaggctacccgattgttgaagaggagttgtttatgtctcaataccgtaaccgagacccggccgatgcccctccgattctcctccttcaaactattctgcttgtcggcgcccatgtcactcgtccgaagtccgaacgcgatacactaaaagacatttttttccgccgtgccaaatggctgttcgacaacaggattgaacggaatcgtgacatcctggttcaggccgcgctcctattgacatggcactcagacctagctgacgacgacgtgtctgccaatgcacattattggattggaatagcggctaggattgccactggactaggaatgcaccgtaatccagtttgcacgctcaacctcgaggattctgatgtctctccgttgacattttcagattttgagggctgcggtgcccgtgtacaggctgattttgtcatccacttttctgagttatgcacgatgatctcttacattgttcgggaacgttttggacttagaatcagcgctgaacgccgcaaggctgcgctccttgaggctgacgaagcccttgcaaactggtcactgagacttccagatagactacgtttgagggcgtcagatatggacccctggtctgccatgcttcatctcacttacaataatttcctaattcttctccatcgacctcatccaagagcttcagcgtactcggatgactatggtccccacgacgccgaaatctgcagcgcagcagctggagtgatagcctcgatttttgaagagcttcgtatacacgatcgactcaagctcctctggtattctggcgtacacactctattcaccgcaatgattcaagtacgggtcgagctccgattttccaacccggttcttgcaatcaatgcccttcgtcgctttgactctgcttcatattccctccgcgagctcgcccagtattggtctcatgccagcaccatcctacgattatttgaggaatcgagacgcctccaggaagatctgcgaactacaaccagtgacagaccccgtcgattcagcaatctcagcaataactctacaaacagccctgcctctcagcagaagaacacctcaggcattcctcacttggcaaatatcaactcatctgatgctacaccacccagcgcccctagcataccccctctacaaccaagcagtcagctatcctacgaagtcccaacaaccgaatctgctcaccataatccacgctcgcaacccacgttaagtgctcatactcacacctatacaacccaaccgtttgacacctggattccatctaacaacctgacacctatggacacagtcgataattcacgcgaaatgcttgactggcgccagctgttttccttcaccgatctggagggaccagtccttccttcaactatggaagggataaccgagctggaagacgagtggcgccagatttactggcaagaaacgccgatgtcggatctcttgcaggatggtgggtggatgcatggg

SEQ ID NO: 38 - protein, 765 aa, Aspergillus nidulans
MSSTAHPTNLAPSGNGSAACVHCHRRKVRCDARLVGLPCSNCRSAGKTDCQIHEKKKKLAVRSILDPVPIRCRPPNPEEAPKPISSLSPSSEPPNAFTTALRAVQSDITAPSGVANRVAHIRSRSSQYDTKGTRSNNNSGNNTQYQNVLPEPDSPPYSRPAASDPSEGESRADIEKRLVNLIDGEASDSRAIQRGVRAIYVGHELSNMSFLIRQQRDTGDDVYHFAGNEIPRRQLRTGHDQLLMDALTLPEPALADELVHAYFAQVNPGYPIVEEELFMSQYRNRDPADAPPILLLQTILLVGAHVTRPKSERDTLKDIFFRRAKWLFDNRIERNRDILVQAALLLTWHSDLADDDVSANAHYWIGIAARIATGLGMHRNPVCTLNLEDSDVSPLTFSDFEGCGARVQADFVIHFSELCTMISYIVRERFGLRISAERRKAALLEADEALANWSLRLPDRLRLRASDMDPWSAMLHLTYNNFLILLHRPHPRASAYSDDYGPHDAEICSAAAGVIASIFEELRIHDRLKLLWYSGVHTLFTAMIQVRVELRFSNPVLAINALRRFDSASYSLRELAQYWSHASTILRLFEESRRLQEDLRTTTSDRPRRFSNLSNNSTNSPASQQKNTSGIPHLANINSSDATPPSAPSIPPLQPSSQLSYEVPTTESAHHNPRSQPTLSAHTHTYTTQPFDTWIPSNNLTPMDTVDNSREMLDWRQLFSFTDLEGPVLPSTMEGITELEDEWRQIYWQETPMSDLLQDGGWMHG

SEQ ID NO: 39 - DNA, 2205 bp, Aspergillus oryzae
atgtcctccaccgcgcataacagccaaccatccaccggcaatggctccgcagcctgtattcactgtcatcggcgcaaagtccgatgcgatgctcgcattgtcggcttaccttgctcgaattgtcgctctgcgggaaaggccgattgccgcatccatgagaagaaaaaacgcctggctgtgcgctccattcttgatccagtccccattcgctgtcgtccgccccctgactccgattctactcccaagctattaccgtccacacctatccagccgaatgccttcacaactgcctttcggggcgtccaacccgacgtgacgagtcctgtcgcagccggtgcccaaatcattcaatcaccacactccagctacaccaatggtaaccatctatccaacaaccgtggttcccaaccgattacggaaacccaaaccttcactcgccaaccgggtgccgaccggtccatggaactagaaaacaacgcagatttggagaagcgactcgtgaagctgattgatgaggaggagtctggcagtcgagaaatccaaaggggtgtgagggcaatctatgttggtcatgaactttcgaatatgtcattcttgatccggcaacagcgagataaagacgacgatgtgtatcactttgcgggcaatgaaattcctcgacggcaattgagaacaggtcatgaccagctccttatggatgccctcacactgccagaaccagcccttgctgatgagctggtagaggcgtactttatgcacgtaaacccagggtatcccattattgaggaggatctgtttatgactcaatatcgtaatcgtgaccccgccgatccgcctccaatattacttctccaagccattttgcttgtcggggcccatgtcacacgtccaaaagcagagcgagatgcgctgaaggaaatcttcttccgtcgtgtcaaatggctattcgacagtcgtattgaacgcaatcgtgatattatggttcaagctgcattgctcatgacatggcactcggacagtgctgatgacgacgtagcggctaatgcccactactgggtgggagtagctgctagaatcgccacaggccttggtatgcaccgtaacccggtatctactatcaaccttgaggactcagatgtctcccctttgaccccttctgactttgaagggtgtggttctcgagtgcaagctgagtatgttattcacttctcagaactgtgtacaatgatcccgtatatcgtgcgagaacgatttgggttgagagtcagcgctgagcgccgcaaagccgccttgcaagaagcagacgaagccctagcgaattggtccctcaagctgccagacagtttacgcttacgagcctccgatatggatccgtggtctgccatgcttcatctgacatataacaacttcctgattcttcttcatcggccacatccaagagcttccgcatattcagacgactacggtccgcatgacgcagaaatctgcagtgcagccgctggagtcatcgcttccatattcgaggaactccgcctcaacgaccggctgaagtttttgtggtactctggagtgcatacgctcttcacagcaatgattcaagttcgggtggaacttcgattctcaaatcctgtcctcgcaatcaacgccttgcgccgcttcgactcggcctcatattctctccgtgaacttgcggagtattggtctcacgccaacaccatcttaaggttatttcaagactctaaacgactccaggaggacttgcgaatggctaccagcgaaagaccaagacgattcagcacacatgatcaaaataaaaacacaactaatccctctaatcctcatcccacccccaccccgaatctcaattcaaataccactatacagagcgcccagaccgagccgcgacctccatacgaagttcctacccctgaatctccgcgtatgcccccaaccaccatgagtccacatcagaaccagccattcgacagctggatcccgtctagccatctggcttctgtggacccaatagaccaacctagagagttcctggattggcgaccagtcttttcctttactgacccggatcagtccgttcttcccgttcccatggaaggattgccagagttagaagatgaatggcgccaaatatattggcaggaaactcccatgtctgatcttctccaggatggaggatggatgcatgga

SEQ ID NO: 40 - protein, 735 aa, Aspergillus oryzae
MSSTAHNSQPSTGNGSAACIHCHRRKVRCDARIVGLPCSNCRSAGKADCRIHEKKKRLAVRSILDPVPIRCRPPPDSDSTPKLLPSTPIQPNAFTTAFRGVQPDVTSPVAAGAQIIQSPHSSYTNGNHLSNNRGSQPITETQTFTRQPGADRSMELENNADLEKRLVKLIDEEESGSREIQRGVRAIYVGHELSNMSFLIRQQRDKDDDVYHFAGNEIPRRQLRTGHDQLLMDALTLPEPALADELVEAYFMHVNPGYPIIEEDLFMTQYRNRDPADPPPILLLQAILLVGAHVTRPKAERDALKEIFFRRVKWLFDSRIERNRDIMVQAALLMTWHSDSADDDVAANAHYWVGVAARIATGLGMHRNPVSTINLEDSDVSPLTPSDFEGCGSRVQAEYVIHFSELCTMIPYIVRERFGLRVSAERRKAALQEADEALANWSLKLPDSLRLRASDMDPWSAMLHLTYNNFLILLHRPHPRASAYSDDYGPHDAEICSAAAGVIASIFEELRLNDRLKFLWYSGVHTLFTAMIQVRVELRFSNPVLAINALRRFDSASYSLRELAEYWSHANTILRLFQDSKRLQEDLRMATSERPRRFSTHDQNKNTTNPSNPHPTPTPNLNSNTTIQSAQTEPRPPYEVPTPESPRMPPTTMSPHQNQPFDSWIPSSHLASVDPIDQPREFLDWRPVFSFTDPDQSVLPVPMEGLPELEDEWRQIYWQETPMSDLLQDGGWMHG

SEQ ID NO: 41 - DNA, 1737 bp, Aspergillus niger
atggactctcatccttcccctaccaaacaaaaggcctccaagcaagcctgcgacaactgtcgtcggcgtaagatcaagtgctcgagagagcttccctgcgataagtgtcgacgccttcttctttcttgttcctacagtgatgtgctccggcgcaaaggccccaagttccgcaccttatatccacttgcgcccattcatcccctggtatcacgacaacagaatacataccaacagaattcgtcacaaaatccgttaaacaagcaatggactgcagatggagtgggctatccgttaagctcactaatgtcgccttctttcacagtggcagaccctcaatacttaccccatgacgctcccgagccgttctctcagtttcctccgccagagctagtctcctcacccgactcaaccaattcattgtcagactctagtatggcactagtgcgcccttatgcacgacgcctgtctgctccggtgctacttgctcatgtgaatgtttatctaaaatatctgttccccatcatgcctgtggtgcggaaggaggagcttcaacaagattgccaccagcctgaacggttatcgccccaacgatatgcctttcttgtcgccctatgcgcagccacacacatccagctgaaactagatggcacagcatctgtcccagaaccttcacaccttcaagccgggattgacgggcattcctggatgtccggcgaagagttgctggctgaagcagtacgcgcaaggaaggattgcgacccagtagacggcatgaacatagaaagccttcttacgtctttcttcctgtttgcttcgtatggtaacctggacaaacaggaccatgcctggttctacctttgtcaggcaacatccatggtcttcacgctggcactccaccgagagtcaagttatgtggatctgagtaccgaagaagcagaggaacgacgcaaggtgttttggctactgtttgtcaccgaaaggggctacgcacttcaacaatcgaaaccggtaatgctgcgtaattcaatccgcaagcctcaagtactttgctccgaagatcctatcttggcctacggtttcatcaatcttattagcatctttgagaaactgaccgtcaacctttatgactgggtctctgcgggaggcatggacggctcgtccgagatgccccctacatctgctattcagtctagtctctgcaacgcaatttcggtcgacggagtctcggagattcaaaaggtcgacatactcatcacccagcaatggctacagacagtaatgtggaaactttctatgactcgtgctactcagcctggatctcgcgatgaggcggttcttccctttcatctccccgttcttgtcggaaaagccgttatgaatgttattggtgctgcatcccagggagctgttgatgttcacggcattggcatggaacaaaaattattcgacctgggttcctcagttgcagacgtggcacgatcactcaactccaaagctgcgcaccgccttactgaagcggccgtcgatcctcgcgaactcctttggggcattcttaccaccttatcacgcatccgcggctctcagtcctacctctttccttcattgttggagcgatgcaaaggcgccctggactttacctcccccacgtcgatgggcaacttcctccctccattatccactgcttccacatggggaagaggaaacggggctcgccgtggtttctgtcccggagaatcc

SEQ ID NO: 42 - protein, 579 aa, Aspergillus niger
MDSHPSPTKQKASKQACDNCRRRKIKCSRELPCDKCRRLLLSCSYSDVLRRKGPKFRTLYPLAPIHPLVSRQQNTYQQNSSQNPLNKQWTADGVGYPLSSLMSPSFTVADPQYLPHDAPEPFSQFPPPELVSSPDSTNSLSDSSMALVRPYARRLSAPVLLAHVNVYLKYLFPIMPVVRKEELQQDCHQPERLSPQRYAFLVALCAATHIQLKLDGTASVPEPSHLQAGIDGHSWMSGEELLAEAVRARKDCDPVDGMNIESLLTSFFLFASYGNLDKQDHAWFYLCQATSMVFTLALHRESSYVDLSTEEAEERRKVFWLLFVTERGYALQQSKPVMLRNSIRKPQVLCSEDPILAYGFINLISIFEKLTVNLYDWVSAGGMDGSSEMPPTSAIQSSLCNAISVDGVSEIQKVDILITQQWLQTVMWKLSMTRATQPGSRDEAVLPFHLPVLVGKAVMNVIGAASQGAVDVHGIGMEQKLFDLGSSVADVARSLNSKAAHRLTEAAVDPRELLWGILTTLSRIRGSQSYLFPSLLERCKGALDFTSPTSMGNFLPPLSTASTWGRGNGARRGFCPGES

SEQ ID NO: 43 - DNA, 1986 bp, Aspergillus nidulans
atggcctcaccagccgctccgaaacacaaacctttcaagcaggcctgtgacaactgtcgccggaggaaaatcaagtgctcacgagagctcccgtgcgacaagtgccagcgcctgctcctttcctgctcctacagcgatgtgctgcgtcgcaaagggccgaaatttcggactctataccctctagcgcctatccatccactagtggccagagaccgacagattctccagtatgatcctccacgattctctgcagagagggaatggtatgcagagcctacgagctacccggtcggcggctcgcccacgtctccgcccttcatggaagagccgcaatatctgccgcctgaacaccctgactcattcagccggctgcctccaccagaactcgtctcttcgccggattctctgaactccctatcggactctccgactgcggtgctgtttcgttcgccgcggattctgaccgcacctgtgcttctggcgcacgtcaatgtctacttgaaatatatgtttcctatcatgcccgtggtccgaagagaagagctccagcaggactgccaccatccagagcgtctaactccccagcggtacgcctttctggcctccctatgtgccgccacacatatccagctgaaactcgacggagcaacgcccgtcgcggatccttcgcattttcaggccggtgagaactcatcaatgtccggtgaagaactgctcgccgaagccgtgcgcgcaaggaaagattgcgacccaattgaggatatgaatgttgagagtcttctaacctcattcttcctatttgcttcatacggaaatctagaccgccaggaccacgcatggttctatctttgccaggcgacatcaatggttttcgcattgggcttgcaccgcgaatcaacatacgccgagttgaacaccgaagaagcagaacagaagcgacgggtcttctggctgctcttcatcacagaacgaggctatgccctccaacaagcgaaacctgtcatgctccgcaactccatccacaaaccgcaagtcctgtgctccgacgacccgattctcgcctacggcttcatcaacctcatcggcgtcttcgagagcctcagcgtcaacctttacgactgggtctcagcagggggaagcgtaagcggaggtggaaataaccgagacggctcctccgagatgccgcctacatcagccatccaggcaactctcagcaaaccgatctcgctcgagggtgtctcggaaatccaaaaggttgatatcctcatcacacagcagtggcttcaggccatgatgtggaaactctccatgacgcgtgcatcgcagccaggctcgcggaatgagacggtcctcccgttccatcttcctgtaatggtgggcaaggctgttatgtctgtcattgcggaggcatcgcagggggctgtcgacgcgcatgggattgggatggaacaaaagctcttcgatcttggtacatctatcgccgacgtctcacgttctctctccacaaaagctgcaaacagcctcgccgagtcaaccgtcgacccccgcgagctcctctggggtatcctttccaccctctcccgcatccgtggctcccagtcgtacctcttcccatctctccttgagcgctgcaaaggcaccctcggctttgattccccgacgccgctttctatcagtgacttccaccagattaatcctccgcttctcaattccgctagctcttcttcaattgcttctgaaactttagatatctctggaccatggcccgcggctgatgacaatactatggattctagcacaggcagcaggacaacaaattcgtgtgcatgggaaataacttctggtgatacgaacgaccagaaccagactagtgatcagccgccttcattgtctggatcatcgtcagtacccctttcggtctcgcgaatgcattcgtccactagtatggctgcagaactctcgtttcaagctgggaggttattgact

SEQ ID NO: 44 - protein, 662 aa, Aspergillus nidulans
MASPAAPKHKPFKQACDNCRRRKIKCSRELPCDKCQRLLLSCSYSDVLRRKGPKFRTLYPLAPIHPLVARDRQILQYDPPRFSAEREWYAEPTSYPVGGSPTSPPFMEEPQYLPPEHPDSFSRLPPPELVSSPDSLNSLSDSPTAVLFRSPRILTAPVLLAHVNVYLKYMFPIMPVVRREELQQDCHHPERLTPQRYAFLASLCAATHIQLKLDGATPVADPSHFQAGENSSMSGEELLAEAVRARKDCDPIEDMNVESLLTSFFLFASYGNLDRQDHAWFYLCQATSMVFALGLHRESTYAELNTEEAEQKRRVFWLLFITERGYALQQAKPVMLRNSIHKPQVLCSDDPILAYGFINLIGVFESLSVNLYDWVSAGGSVSGGGNNRDGSSEMPPTSAIQATLSKPISLEGVSEIQKVDILITQQWLQAMMWKLSMTRASQPGSRNETVLPFHLPVMVGKAVMSVIAEASQGAVDAHGIGMEQKLFDLGTSIADVSRSLSTKAANSLAESTVDPRELLWGILSTLSRIRGSQSYLFPSLLERCKGTLGFDSPTPLSISDFHQINPPLLNSASSSSIASETLDISGPWPAADDNTMDSSTGSRTTNSCAWEITSGDTNDQNQTSDQPPSLSGSSSVPLSVSRMHSSTSMAAELSFQAGRLLT

SEQ ID NO: 45 - DNA, 1812 bp, Aspergillus oryzae
atgtctcattctccaaccgacattccctcaacatccgaaaaggaaatggagtcaaccccagaaaagccgcctaaacaggcctgcgacaattgccgtcgacgcaaaatcaagtgttctagagagcttccatgcgacaagtgccagcgtcttcttctctcctgttcctacagcgacgtgctccgtcgcaagggccccaagttccgcacgctctaccctctcgctcccatccatccactcgcctcacgaccacgtcctctcaccaaggaatggctgcccccaaacccaggggcttgccatttggcgtccccgacgtctccgccgtccaccgtagcggacgcccagtatctacatccagacttctcggagtcgttcactcgactaccacccccagatctcgtctcctctcccgactcgacaaactcgctattcgactcgtccactatcggcgcactccccgcgccacgccgtctgtcgacgccaaaccttctagcccatgtcaatgtcttcctcaagtacctgttcccgatcatgcccgtcgtgagacaggaccagctgcagcaggactgccaccagccggagcgcttgtctccccaacgctacgctttcattgccgctctatgcgcggccacgcacatccaactgaagctggacggtgcagcaccgggtcccgaggcggcttccgcgcgagccagcctcgacggacatcctatgttgtcgggagaagaactcctggctgaagccgtgcgcgcaagaaaggaatacaacgtggtcgacgaaattaacatggaaaacctcctaacctccttctttctcttcgccgcctacggaaacctagacagacaggatcaggcctggttctacctatgtcagaccacgtccatggtcttcacactaggcctacaacgggaatccacatactcgaaactaagcgtcgaggaagcagaagagaaaaggagagtattctggctcttattcgtcacagaaagaggctacgcattacaacaagcaaaaccagtcatgctccgcaactccatccacaaaccacaggtcctgtgctcagacgacccaatcctagcctacgggttcatcaacctcatcaacgtcttcgaaaagctcagcccaaatctctacgactgggtctccgccggcggcagcagcgcagacggcgaccccccgcctacttcttctatccaatccagtctcgccaagcaaatctccctcgagggcgtctccgagatccagaaagtagacatcctcatcactcagcaatggctacaaaccatgatgtggaaactctccatgacccacgtcacacagcccggctctcgcgatgacgccgttctccccttccacctgcccgtgctagtcggcaaggccgtcatgggcgtcatcgccgcggcatcccaaggtgctgttgacgctcatggtatcggaatggaacaaaaactctacgacctcggcacctccgtagccgacgtctcccgctccctaagcacaaaagccgcccaccacctcgccgaatcgaccatcgacccccgagaactcctctggggcattctcacaaccctatcccgaatccgcggttcccaatcatacctcttcccagcgctcgtcgagcaaagtcgaggcatcatcagtttcgactgttcgctttccatcagtgactttctgccttcgtttggtgggccgccggctattatgtggcggacgggtgaatctgggtttgatttattggggatcgcggatgatttgcaagagagggagaatgagggtggggaggggattgtggtggctggggaggagatttcgttt

SEQ ID NO: 46 - protein, 604 aa, Aspergillus oryzae
MSHSPTDIPSTSEKEMESTPEKPPKQACDNCRRRKIKCSRELPCDKCQRLLLSCSYSDVLRRKGPKFRTLYPLAPIHPLASRPRPLTKEWLPPNPGACHLASPTSPPSTVADAQYLHPDFSESFTRLPPPDLVSSPDSTNSLFDSSTIGALPAPRRLSTPNLLAHVNVFLKYLFPIMPVVRQDQLQQDCHQPERLSPQRYAFIAALCAATHIQLKLDGAAPGPEAASARASLDGHPMLSGEELLAEAVRARKEYNVVDEINMENLLTSFFLFAAYGNLDRQDQAWFYLCQTTSMVFTLGLQRESTYSKLSVEEAEEKRRVFWLLFVTERGYALQQAKPVMLRNSIHKPQVLCSDDPILAYGFINLINVFEKLSPNLYDWVSAGGSSADGDPPPTSSIQSSLAKQISLEGVSEIQKVDILITQQWLQTMMWKLSMTHVTQPGSRDDAVLPFHLPVLVGKAVMGVIAAASQGAVDAHGIGMEQKLYDLGTSVADVSRSLSTKAAHHLAESTIDPRELLWGILTTLSRIRGSQSYLFPALVEQSRGIISFDCSLSISDFLPSFGGPPAIMWRTGESGFDLLGIADDLQERENEGGEGIVVAGEEISF

SEQ ID NO: 47 - DNA, 933 bp, Aspergillus nidulans
atgacggcgcgccaatcaacaccgtcctccgacaactcgcactcagacagcggcgtccgcaagcgagtatgcaaggcttgcgatcgttgccgactgaaaaagtccaagtgtgacggagccaaaccatgcggtcgctgtcgagcagacaacacgctctgtgttttcggcgagaggaagaaagctcatgacaaagtgtaccctaaggggtatgttgagatgctggaacaacaacaaacttggctagtcaatggcctgcaagaactgtatcgccgccttcttgagggtgatggatggccgggcgagccgctgaaatgcgaagcgaacgggcagcccttgacacacgatctcttgacgcagctcggcgctctcgacacaagcaagcacgagcggttcgaagaacacgccgaggtcatgcagcaggaattatggaagcgaaatgccggacacatgcagcgccaggactcatcagataccagctccgagagcccacagtcgcccgtcatgccgtctcaattctcagatcccttttctgtgcgcacagtaccacaaactccgacaacgatcagcccgaacacgacgctgcgaatagacgtcccgcaatcagcgacgaagagtgaaccgcagatgacatcgccaaactccatatacaccacagccgtgtccatgccgcgagtggtcgacccgtctgagctgcagagcgcccaaatagcaaacccgcagtggcccagccctggctttggaggctacgacgaaatggacctgatgtctgggcaatacaatggtctgccatacgaagatgcgatctcctcgccaatgttcaatcgtccaatgccaatggggtgcctgataccagggtcatacgggaacttggataacaagaacgactttgaggatatcaaccaatttctgaacacacagttggagattacgtcg

SEQ ID NO: 48 - protein, 311 aa, Aspergillus nidulans
MTARQSTPSSDNSHSDSGVRKRVCKACDRCRLKKSKCDGAKPCGRCRADNTLCVFGERKKAHDKVYPKGYVEMLEQQQTWLVNGLQELYRRLLEGDGWPGEPLKCEANGQPLTHDLLTQLGALDTSKHERFEEHAEVMQQELWKRNAGHMQRQDSSDTSSESPQSPVMPSQFSDPFSVRTVPQTPTTISPNTTLRIDVPQSATKSEPQMTSPNSIYTTAVSMPRVVDPSELQSAQIANPQWPSPGFGGYDEMDLMSGQYNGLPYEDAISSPMFNRPMPMGCLIPGSYGNLDNKNDFEDINQFLNTQLEITS

SEQ ID NO: 49 - DNA, 2640 bp, Saccharomyces cerevisiae
atgggaatttccagcaagaatggccctaaaaaaatgggaagggcaaagacgtttactgggtgttggacgtgcagaggaagaaaagttaagtgtgatcttcggcatccccactgccaacgatgtgaaaagtctaatttgccttgtggcggttatgatatcaaactccggtggtctaagcctatgcaatttgacccgtacggtgtcccaatcccacaaaattctcctgcaactactacgaacttatcaggtagtgtcgatgaaccacaataccaacgacggaacatcgattttgtgcgctatgatgaagaatacgtgtatcatgaagatatggatgatgagctaacaatgctgcatactcccccaattgagaaaataagcgataacaagacgtggatcataaagaaatttggggtgtttaaaggaacagataagatcgacaagcagtacgctccaaggaagaagcgcaataggaaaagagttgccaaaagcttggagagctcagcttctatttcgttatcttctttaccatcttcttcaactatttcctttccaattagacatattgaagacaagttgagaaataaagggcatgtaaagacaggtattctctctgctaatgatggtgttccaccaacaccaaatcttttagattatgactggaacaatctgaatataacaggttacgaatggatctcgagtgaactcagagatgatgcattattgtcagcggtgaccttacagggacatcacttaggacacacacagccacaagaaatctcattagaggaaaactctaatgtcgtgagtggggaagagcatgtgaatgccaaagaacatggatgtgcctttgaggctgataatcaaggttcatcaactttacctaataaagcagccagtgccaatgataaactttaccagcaaaacttgaagttactcttccagaaaaactcttcgaacagtgaggaaccagaccctcaagcattgatcgacgatgtgttcgtcaatattgaaccaagatctctgcccgcatctgatctgaataaaataactctagctcctccaaatgaagaatcacgcatgcctaagtccatgttagaactcacatcctattccagtgacctaccacctgaattggtagatattatacccaaaacagaccttaccgtacatggtttagcgagatttcttttaaatcattattttaataatgttgcagataaaatgacagtggtcgtgctcgaaaagaacccatggaaaacattatacttccccagagccttgatggcattaggcgatttagcgggtttgggacaatcctccaactcgaggaatgcgttgttgaatgctcttcttgctgtctcttgcttccacttgcaaagcaagtacccaaggaactacaaactacaaaaatactttctgggcctaggtatcgaattgagaaatcaagcctcgaactttctaagattatgtttgaacacaaaatcaagcatacctgagaaatataaagacgtactaactgcgatcttatctatgaactctattgatgttgtatgggggacgatggcagattgccaggatcacttggctctttgtgaagacttcgttgagtcaagaatgaaactaagacctaatatttctgaaaagacaaaaaccttacacaggattttctcgtttctgaagttaattcaagatagcactgcgttggataaagtcagggcaaaggaaattgttattttaccaagtgaagaagatgataattacaaaccattagatacatctaacgctactaccagtagcagtgagccaagagttgacgttgtgcaggaaggtttatttagagaggcactcaatgaaaatgacggcaaaatacatattgaattcgttaaggagcctatcacaaacgtatccgctgactctactccatcttcgaccactcctccaatttttaccaacatagcaacagaaagttactataataaatctgatatatctaagctagtatcgaagactgatgaaaacataattggtacagattcactctatggattgcctaattcattaatattactattttcagactgtgttaggatagtgagacataatgaatattataatttaacttacctacctgtaccccgaaaatttaatgaactctcgttaaatttcgaaaaaagattattgaaatggaaatcagaatggaacttccatcaagaaaattcggagggaaaaagcttcataaactcaacggctgaagcactatatcaccatacaatgagcttttatttcagtttaattatttattattttacaatggcaagaagtttaaattgccaatttctacaaaactatgttgccaaagtattagatcacttaaatgcaatggaagaattggtggatcaaaaaaaagtgaaaattgtccctttaatttggcaaggtttcatggcaggatgtgcttgcacagatgaaaacagacagcaagagtttagaagatgggcagccaaattagctgaaagtggagtgggctcctattggggagccaggcaagtaatgttggaagtttggaggcgacggaaagaggatgagccgggcgataattggtattctgtttataaagattgggaaatgaatctgatgctatca

SEQ ID NO: 50 - protein, 880 aa, Saccharomyces cerevisiae
MGISSKNGPKKMGRAKTFTGCWTCRGRKVKCDLRHPHCQRCEKSNLPCGGYDIKLRWSKPMQFDPYGVPIPQNSPATTTNLSGSVDEPQYQRRNIDFVRYDEEYVYHEDMDDELTMLHTPPIEKISDNKTWIIKKFGVFKGTDKIDKQYAPRKKRNRKRVAKSLESSASISLSSLPSSSTISFPIRHIEDKLRNKGHVKTGILSANDGVPPTPNLLDYDWNNLNITGYEWISSELRDDALLSAVTLQGHHLGHTQPQEISLEENSNVVSGEEHVNAKEHGCAFEADNQGSSTLPNKAASANDKLYQQNLKLLFQKNSSNSEEPDPQALIDDVFVNIEPRSLPASDLNKITLAPPNEESRMPKSMLELTSYSSDLPPELVDIIPKTDLTVHGLARFLLNHYFNNVADKMTVVVLEKNPWKTLYFPRALMALGDLAGLGQSSNSRNALLNALLAVSCFHLQSKYPRNYKLQKYFLGLGIELRNQASNFLRLCLNTKSSIPEKYKDVLTAILSMNSIDVVWGTMADCQDHLALCEDFVESRMKLRPNISEKTKTLHRIFSFLKLIQDSTALDKVRAKEIVILPSEEDDNYKPLDTSNATTSSSEPRVDVVQEGLFREALNENDGKIHIEFVKEPITNVSADSTPSSTTPPIFTNIATESYYNKSDISKLVSKTDENIIGTDSLYGLPNSLILLFSDCVRIVRHNEYYNLTYLPVPRKFNELSLNFEKRLLKWKSEWNFHQENSEGKSFINSTAEALYHHTMSFYFSLIIYYFTMARSLNCQFLQNYVAKVLDHLNAMEELVDQKKVKIVPLIWQGFMAGCACTDENRQQEFRRWAAKLAESGVGSYWGARQVMLEVWRRRKEDEPGDNWYSVYKDWEMNLMLS

SEQ ID NO: 51 - DNA, 2637 bp, Saccharomyces cerevisiae
atgggaattttcagcaagaatggccctaaaaaaatgggaagggcaaagacgtttactgggtgttggacgtgcagaggaagaaaagttaagtgtgatcttcggcatccccactgccaacgatgtgaaaagtctaatttgccttgtggcggttatgatatcaaactccggtggtctaagcctatgcaatttgacccgtacggtgtcccaatcccacaaaattctcctgcaactactacgaacttatcaggtagtgtcgatgaaccacaataccaacgacggaacatcgattttgtgcgctatgatgaagaatacgtgtatcatgaagatatggatgatgagctaacaatgctgcatactcccccaattgagaaaataagcgataacacgtggatcataaagaaatttggggtgtttaaaggaacagataagatcgacaagcagtacgctccaaggaagaagcgcaataggaaaagagttgccaaaagcttggagagctcagcttctatttcgttatcttctttaccatcttcttcaactatttcctttccaattagacatattgaagacaagttgagaaataaagggcatgtaaagacaggtattctctctgctaatgatggtgttccaccaacaccaaatcttttagattatgactggaacaatctgaatataacaggttacgaatggatctcgagtgaactcagagatgatgcattattgtcagcggtgaccttacagggacatcacttaggacacacacagccacaagaaatctcattagaggaaaactctaatgtcgtgagtggggaagagcatgtgaatgccaaagaacatggatgtgccgttgaggctgataatcaaggttcatcaactttacctaataaagcagccagtgccaatgataaactttaccagcaaaacttgaagttactcttccagaaaaactcttcgaacagtgaggaaccagaccctcaagcattgatcgacgatgtgttcgtcaatattgaaccaagatctctgcccgcatctgttctgaataaaataactctagctcctccaaatgaagaatcacgcatgcctaagtccatgttacaactcacatcctattccagtgacctaccacctgaattggtagatattatacccaaaacagaccttaccgtacatggtttagcgagatttcttttaaatcattattttaataatgttgcagataaaatgacagtggtcgtgctcgaaaagaacccatggaaaacattatacttccccagagccttgatggcattaggcgatttagcgggtttgggacaatcctccaactcgaggaatgcgttgttgaatgctcttcttgctgtctcttgcttccacttgcaaagcaagtacccaaggaactacaaactacaaaaatactttctgggcctaggtatcgaattgagaaatcaagcctcgaactttctaagattatgtttgaacacaaaatcaagcatacctgagaaatataaagacgtactaactgcgatcttatctatgaactctattgatgttgtatgggggacgatggcagattgccaggatcacttggctctttgtgaagacttcgttgagtcaagaatgaaactaagacctaatatttctgaaaaggcaaaaaccttacacaggattttctcgtttctgaagttaattcaagatagcactgcgttggataaagtcagggcaaaggaaattgttattttgccaagtgaagaagatgataattacaaaccattagatacatctaacgctactagcagtagcagtgagccaagagttgacgttgtgcaggaaggtttatttagagaggcactcaatgaaaatgacggcaaaatacatattgaattcgttaaggagcctatcacaaacgtatctgctgactctactccatcttcgaccactcctccaatttttaccaacatagcaacagaaagttactataataaatctgatatatctaatctagtatcgaagactgatgaaaacataattggtacagattcactctatggattgcctaattcattaatattactattttcagactgtgttaggatagtgagacataatgaatattataatttaacttacctacctgtaccccgaaaatttaatgaactctcgttaaatttcgaaaaaagattattgaaatggaaatcagaatggaacttccatcaagaaaattcggagggaaaaagcttcataaactcaacggctgaagcactatatcaccatacaatgagcttttatttcagtttaattatttattattttacaatggcaagaagtttaaattgccaattcctacaaaactatgttgccaaagtattagatcacttaaatgcaatggaagaattggtggatcaaaaaaaagtaaaaattgtccctttaatttggcaaggtttcatggcaggatgtgcttgcacagatgaaaacagacagcaagagtttagaagatgggcagccaaattagctgaaagtggagtgggctcctattggggagccaggcaagtaatgttggaagtttggaggcgacggaaagaggatgagccgggcgataattggtattctatttataaagattgggaaatgaatctgatgctatca

SEQ ID NO: 52 - protein, 879 aa, Saccharomyces cerevisiae
MGIFSKNGPKKMGRAKTFTGCWTCRGRKVKCDLRHPHCQRCEKSNLPCGGYDIKLRWSKPMQFDPYGVPIPQNSPATTTNLSGSVDEPQYQRRNIDFVRYDEEYVYHEDMDDELTMLHTPPIEKISDNTWIIKKFGVFKGTDKIDKQYAPRKKRNRKRVAKSLESSASISLSSLPSSSTISFPIRHIEDKLRNKGHVKTGILSANDGVPPTPNLLDYDWNNLNITGYEWISSELRDDALLSAVTLQGHHLGHTQPQEISLEENSNVVSGEEHVNAKEHGCAVEADNQGSSTLPNKAASANDKLYQQNLKLLFQKNSSNSEEPDPQALIDDVFVNIEPRSLPASVLNKITLAPPNEESRMPKSMLQLTSYSSDLPPELVDIIPKTDLTVHGLARFLLNHYFNNVADKMTVVVLEKNPWKTLYFPRALMALGDLAGLGQSSNSRNALLNALLAVSCFHLQSKYPRNYKLQKYFLGLGIELRNQASNFLRLCLNTKSSIPEKYKDVLTAILSMNSIDVVWGTMADCQDHLALCEDFVESRMKLRPNISEKAKTLHRIFSFLKLIQDSTALDKVRAKEIVILPSEEDDNYKPLDTSNATSSSSEPRVDVVQEGLFREALNENDGKIHIEFVKEPITNVSADSTPSSTTPPIFTNIATESYYNKSDISNLVSKTDENIIGTDSLYGLPNSLILLFSDCVRIVRHNEYYNLTYLPVPRKFNELSLNFEKRLLKWKSEWNFHQENSEGKSFINSTAEALYHHTMSFYFSLIIYYFTMARSLNCQFLQNYVAKVLDHLNAMEELVDQKKVKIVPLIWQGFMAGCACTDENRQQEFRRWAAKLAESGVGSYWGARQVMLEVWRRRKEDEPGDNWYSIYKDWEMNLMLS

SEQ ID NO: 53 - DNA, 2214 bp, Schizosaccharomyces pombe
atgcagaagaaagtcgttcagtctgcttctaagaatgaggagcttgatccacattacaagcggtcctccgttcctttcccttatggattacccgattacgatgcagaatatcaattcatcaatcatcatatgcaacaattgcttacccgcccagtagaaggtactcattctgcctctgtacatccctccacatcttccacctctcatatctcttctccctctgctttttcagtgcaaaacccaaatccaaatgatgctccgtttgtgggaaacattggcttggatgcatctgggttttcctccggtggcatgagtgaatactatccaagatctgtttctatgcaacagtctcaagacgtccatttccaaaataccgaaattccatactaccatcgttctccatcgtctgatagtttttcacctggggtggttgcatctgttaaccctaattcaaacaactctcctactttttactcaaatcctcctgcattatctaatattccgattcccttaaacaactctccctatcgtcctgaagatgcttattttcagttacaaggtgctggagtgaaggcagacataaatccatacaacttgtctccctattctcaatatggtccagagggcactgcatattcaaatgcgcaagctcatcatcaggatggtgctcctttgcagcgcgtttgttcagcacccgatcctcctaaaacctctatgccaccttttggatccgccgggagtccatctcctaatcgtagtttaaacgtttccaacaacacgactcctcctctttccactgtgaataaaattataaaaaagcctaaagctactaccggtaaagttaagaaaagacttcctcaggccaagagagcttgcgcaaagtgtcaaaaagacaacaaaaaatgtgatgacgctcgtccttgtcagcgttgtattaaagccaaaactgattgcattgatttacccaggaagaaacggccaacgggagttagaagaggcccttataaaaaattgagtgatacttcgaacaacaccaagtcaactactgcatcttctggtcattccacgcaagattctctcagttctaaaatgttggatccttcaagtgacaatcagtttgccatgtcttccagacagatggatgaaaacggaatggcccagtatccttcctcagctattaaacaagaactaaatcttcaaccccagatacttgtttcatctgcttcaaagaactttcaacctaatgtcactcctccttttgctgtccatcatgatcatttcaattcaacatcaatggatggtgtggcggtatctaacatggacgaaactggaacttcctcagctggttcaaagccttttaatcgaaaatctcgaaaccgaagttttactaatccagttggtatgaccgaggagcattttctaagagaatatgcgcaacactctgtagctaatccttctttgctaattcatcagatccatggtttaccttctgaacaagtccatggcttattatctcatacggaactcggtaatgcaatgcataatcaaccgacgtataacgaaagctcaattgccgctgagaatgtgaacaattggatgttagaaacgaatgaccacgaaaatttgtccatgcagagccattttgaggttcccgatttaaaaatgaaccatcacgattctagcttttttgaccgtcacatagaccaaacggctatgcctggacaaaatcaacatggtactgttaagaatatggaaacaatgcaccatttttatccagacgttcataattcggagtttcctgctgccccaaatcccgtcaagtctcaagttccttattattatcaatcccaagctgctgatgatgaggaagaagatgtaccggatcatcaaccttcttggcgtgggagaatacactcgttttcaatagctactgattcgtcacagcatgtggtagaaagaccatgtatccattcattaagaggaatacatggacaacaggatggcgggcttgaacaacatgatggtgatcatgtgaatatgcttcctgatacccatgcggaggagctagcgtacacatccatgcttttatttcatgatatacctacacgagacattagacccgactttaacgttcatgagctagtcgatcatggaacctatcctaacttccatcaaaaccaagccgattcattcaagaatcatccctttagacaa

SEQ ID NO: 54 - protein, 738 aa, Schizosaccharomyces pombe
MQKKVVQSASKNEELDPHYKRSSVPFPYGLPDYDAEYQFINHHMQQLLTRPVEGTHSASVHPSTSSTSHISSPSAFSVQNPNPNDAPFVGNIGLDASGFSSGGMSEYYPRSVSMQQSQDVHFQNTEIPYYHRSPSSDSFSPGVVASVNPNSNNSPTFYSNPPALSNIPIPLNNSPYRPEDAYFQLQGAGVKADINPYNLSPYSQYGPEGTAYSNAQAHHQDGAPLQRVCSAPDPPKTSMPPFGSAGSPSPNRSLNVSNNTTPPLSTVNKIIKKPKATTGKVKKRLPQAKRACAKCQKDNKKCDDARPCQRCIKAKTDCIDLPRKKRPTGVRRGPYKKLSDTSNNTKSTTASSGHSTQDSLSSKMLDPSSDNQFAMSSRQMDENGMAQYPSSAIKQELNLQPQILVSSASKNFQPNVTPPFAVHHDHFNSTSMDGVAVSNMDETGTSSAGSKPFNRKSRNRSFTNPVGMTEEHFLREYAQHSVANPSLLIHQIHGLPSEQVHGLLSHTELGNAMHNQPTYNESSIAAENVNNWMLETNDHENLSMQSHFEVPDLKMNHHDSSFFDRHIDQTAMPGQNQHGTVKNMETMHHFYPDVHNSEFPAAPNPVKSQVPYYYQSQAADDEEEDVPDHQPSWRGRIHSFSIATDSSQHVVERPCIHSLRGIHGQQDGGLEQHDGDHVNMLPDTHAEELAYTSMLLFHDIPTRDIRPDFNVHELVDHGTYPNFHQNQADSFKNHPFRQ

SEQ ID NO: 55 - DNA, 212 bp, Schizosaccharomyces pombe
atggggaaaccaaaaagaattcctagagcttgtgacatgtgtagaaaaaggaagattcgctgtgatggaaagcaacctgcatgttcgaattgcgttagtcacggaatcccatgcgtatttacagctagacctaaaagaagaacaggtcagagacaaatgtacattaagtcgctcgtttctagattagaacaaatggagtctactctgagatc

SEQ ID NO: 56 - protein, 71 aa, Schizosaccharomyces pombe
MGKPKRIPRACDMCRKRKIRCDGKQPACSNCVSHGIPCVFTARPKRRTGQRQMYIKSLVSRLEQMESTLRS

SEQ ID NO: 57 - DNA, 564 bp, Schizosaccharomyces pombe
aaagacttgagcctggaactccaaaaggttatgatggttcaaaaaactcatctcctgcttctgttccaagttggattcacgaaaagacaaaggctggaaaggatcgaaaacggtttacctttagcctgtcaatcttgtcgaaagaagaaagttaagtgttcgggagagcgtccttcgtgtgatcaatgcttaaaacataatattccttgtatatacaaatcaaattcaacaaagcgttctcactcacgccatgaagagattcatcatcagcaacagttacatctcaatcatcagtatcaacaccaacacaagaatgtcgctgcaaattcaatagataatctttctcggcaatattctcaaccaaatcacattaatacgcacgattctgttaacagccctccttcttatgggattatggcttctgctacaaaccagcctctttcccatccaactatagtaccttcttcaaattcttcgtctcttcttaattctacaaacaatatttctcataatcctcaggtttcgctgatgtcagcatctctctccaaaaatttggtcctagat

SEQ ID NO: 58 - protein, 188 aa, Schizosaccharomyces pombe
KDLSLELQKVMMVQKTHLLLLFQVGFTKRQRLERIENGLPLACQSCRKKKVKCSGERPSCDQCLKHNIPCIYKSNSTKRSHSRHEEIHHQQQLHLNHQYQHQHKNVAANSIDNLSRQYSQPNHINTHDSVNSPPSYGIMASATNQPLSHPTIVPSSNSSSLLNSTNNISHNPQVSLMSASLSKNLVLD

SEQ ID NO: 59 - DNA, 1236 bp, Pichia anomala
atgtcacaaatccctgatgacagacctcaaacaaatacaacaaatctagatccaaacaatgggaatattcaacctaatgactccagtaaaggagcaacagattactggggcacagatatgcttagccctgagtttaatttcctcaatgttccagaggaaacttataatttcctccagtcaggcccatcattgaatgatagaaatgcaccttcaccaagtctattcaataataatacaggtatctcaaacataccgtcaaacccttcaagtgcacacggaactcctgttgaatcaaatgctcctgcaaagactgaacaacaaaactttttattaaaccattatcaaaatctattaaatcaaagtaaagttccaatgaaacaagctttatccccaaattcatatgcttctccaacagcaaatagtaccaattcccatactgctggctctccatcctcaaatatacctattaatcatcctttacatcctgataatgttcaaaaatcactacaacagcaacagcaacaagcccaatcatttcaacaaccacaatcattatttcaagaagcttcacaaacgaccaaaggtaaccctaatccttgtgatcattgcagaagaagacaaatcaaatgtatcacggtgcccaatctgtcaaactgtgttcaatgtgaaactaaaggtattaaatgtacccattcagaaagtccgtcaaatccagctttgaaaagaaatatgggaatggttcaagataccaatgaattcaataaaagacctagatactcggtcaaccaagtacaaaaaccaaccttcccacaagttcaaaatttcaaaaaacctcaaccaacattacaatatccaagatcatcatttttcgttgggtcttcctcgatgtttgaccattctttattgaaccgtataaggctggacaaaatagatcaagttcaattgaatccaaaactgtcattaagaaaagtttctaatgatgttcaattcatattaagagatgattatactgatgaattggcactgagtgctgatcgaaatgttgatgctgtggagaatatagtggcacctcatggacaatcattagtgaatacttatttcaaaatcatacatccgtcattcccaatattgcatagaaaagtgtttttagaaaaatatgcaagatcttatagagaattttcagctccattattagctgcagtttattcattagcaattcaatggtgggaccaggat

SEQ ID NO: 60 - protein, 412 aa, Pichia anomala
MSQIPDDRPQTNTTNLDPNNGNIQPNDSSKGATDYWGTDMLSPEFNFLNVPEETYNFLQSGPSLNDRNAPSPSLFNNNTGISNIPSNPSSAHGTPVESNAPAKTEQQNFLLNHYQNLLNQSKVPMKQALSPNSYASPTANSTNSHTAGSPSSNIPINHPLHPDNVQKSLQQQQQQAQSFQQPQSLFQEASQTTKGNPNPCDHCRRRQIKCITVPNLSNCVQCETKGIKCTHSESPSNPALKRNMGMVQDTNEFNKRPRYSVNQVQKPTFPQVQNFKKPQPTLQYPRSSFFVGSSSMFDHSLLNRIRLDKIDQVQLNPKLSLRKVSNDVQFILRDDYTDELALSADRNVDAVENIVAPHGQSLVNTYFKIIHPSFPILHRKVFLEKYARSYREFSAPLLAAVYSLAIQWWDQD

SEQ ID NO: 61 - DNA, 1587 bp, Pichia anomala
atgaacttgcagacccagaggatctgcacttcgtgtaaactattgcgacgaaaggactgcgatggcaaagttccctcatgtttgaactgcattaaaagaaagcgggaatgtatctatcaagccgacagcgataagcgaagacgaaagtaccatacagattatacccaatatctggagaaaaaagtccgtgttctacaggactttctctccaaaaacgacccgcagttacagcttggtgaaaatggtgaacaaactcaaattcagtttttgaagcgggtggacgaagaagcaaaattgaccacccttcttaatgagatggatgatctgcgtctcgacaactccccggagcctgattttcagtacgacgatcttggacctttggttggagtagccgggctcaacttgtactacattgatcctatattcaaaacagagctgctttctttattcaaaaaacactgttcggagatcacctatgctatcacgctcacattacccaccctcgatacatgggttttttcgaccgacacggacccttcccatcagctgcttatgctcaccgtgtatggggttgcttgcttatattctaaaaatccacatgcgtccaaaatcagtaaattactgatgaaccaggctgcgcaaattgcagatatgcgtcgaaggttcaacttagacgaatacctactccaaggccttctgcttctttcttgctacgaaatgggcatgggcaatgactcgatgtcttatctgtacatttcgatggcatgttctttgacgcagcatatgggactccatatatcttatgacgagcattcttcagccgccaaatttgcacctcgaaccactccgttccaatctgcacttctatggtctatttgtacgcaggatagaattatcacgtcaaggattggtgtgccttcttgcattcactttaagcgaattatctctcctgtctatgaagtgcaactctcgcggaacgatcctagttatttggaagagctttgtttttgctacactactcgcgtgtggtatataatggacaggtttacagaccaaatatgctctatacaaggtgatttaggtgatacgcaggaacgaggaaaactgcttaaaaccgctgagcttgcattccaggctttgaaaaattcattaccaatgcccttccgagatgaaaaacactctaagaactaccatataataatgtttcagctaaactacgaagcttgcgtggtattgctacaccggttgtttattgacgaccctttgtgccgcaacaaatgcgttacctcggccacggaaataaccaagctgactcggatcctgcttgaaacaggaggcatcgaacgagcgtcctaccattttgctttcattagctctttagcagcaatgatacatctagtgctatactctgagaagctacgtccagaacaccttctcaacttggaaacctgtgtcacggctctgaaaatttccggacaacgatggaaaaggggtgcactgcaactagagatgctatgtgaattttcgcaaagccacggaatcaatgtgccaattctagaaacgttctcgtccaggtggacaaaattt

SEQ ID NO: 62 - protein, 529 aa, Pichia anomala
MNLQTQRICTSCKLLRRKDCDGKVPSCLNCIKRKRECIYQADSDKRRRKYHTDYTQYLEKKVRVLQDFLSKNDPQLQLGENGEQTQIQFLKRVDEEAKLTTLLNEMDDLRLDNSPEPDFQYDDLGPLVGVAGLNLYYIDPIFKTELLSLFKKHCSEITYAITLTLPTLDTWVFSTDTDPSHQLLMLTVYGVACLYSKNPHASKISKLLMNQAAQIADMRRRFNLDEYLLQGLLLLSCYEMGMGNDSMSYLYISMACSLTQHMGLHISYDEHSSAAKFAPRTTPFQSALLWSICTQDRIITSRIGVPSCIHFKRIISPVYEVQLSRNDPSYLEELCFCYTTRVWYIMDRFTDQICSIQGDLGDTQERGKLLKTAELAFQALKNSLPMPFRDEKHSKNYHIIMFQLNYEACVVLLHRLFIDDPLCRNKCVTSATEITKLTRILLETGGIERASYHFAFISSLAAMIHLVLYSEKLRPEHLLNLETCVTALKISGQRWKRGALQLEMLCEFSQSHGINVPILETFSSRWTKF

SEQ ID NO: 63 - DNA, 2601 bp, Schizosaccharomyces pombe
atggatcttaacaccttgccttttcattccatcaattctgtcaatgtttcatctgcacctacagtcaatgaacgttcgtatccgttcttgttagatgcttccgctggtgtctctggttttaatcctgtcgtcagctctcctgaaaaaaaagctcgtatgaaatacaagaaaaactctacatcacccaatatggatgtaaaatctcgtaaaaaggtttctcgcgcttgcgatttttgtcggcagaaaaaaattcgttgtgatatggatcaaagtcctcgtcctggcaacgcttgtattaattgtcgtaagcatcatctcgattgcaattttactcgaacacccctaaaacgcggtcctgccaaagggtttaatcgaaatgctgatgaaaaacaaaagcgagcctctggttctgctaaatcatcttctcctgctgtaaatggttctgtattttccggaaacgaagcaagtcccagttcaagggctccgtcgataactccagttgattccgtgaataccactactagcgcaatacaggtaccatcggttactcttacagcaccagctcctttaggagtcgatcaaaaaatctcgcaagatcaaaaaccagattcttggctgacatataatgcccaattcgcgcaaaattctccccagttagctccttcaatacctagtcctatgaaactatcacccgccaaccaacaggctatgccaccttacccgcaaatgttgggccctggctcaataagctcttataccaattcgaatttaggaccttctgccggttttcgacctccaactttttttagtagtcctagtccacagccgtattctggccctatacttgcttctaccgctcctacattggatggtagttatttatctaatccttcaaacagcaatcctgctgtcatgtccttatctagtaactttccttcccctcccaagccaaacaatccagtttacttacctcctcgagggaatcctaccgtaaatgatagggtttctaatgtacttccttctattacatctttcgatagcagcgttactaccgtcccttctaactcacctgccactcttaacagttacactacaagtgtccctagcggcatgtctcgccatcccatgttaatgaatccatctactcctgaaccatctcttggcgttaattctccatctttgagaccactgcaaagcttaaacaatgtgcaaaattcatatcgtgttgcatctactcaggctcctccacctcaccccttacggaattatacatcagatgctgagtcaatttcgatgcgttccaaaagtactcaagcttcagatgctgcaacatttcgtgaggttgaacaactttatcaggagaatgttgaatgggatgatgctgctatagatagatattacttgcttattcattcaactttaccaatcctgcatcattccaaggcaaggttaaagtccgagcttgagaaagctcccataaacctgcgctcttcctgtttacatgccatctactcacttgttaaccgaccaccatttgctactttaggtcatgtgtttcataatactcctatgaaagcaattgggttgctcaacttgatatgtagtaatgttcaggatctctcaaatcggattttgcatctgcagactatgattttacttgctattgaaagtgatcagcgtggacctactactattactggtcgaaatggattaccacagggaatgtggctaggcgctgctattggattagcctgtaacatgagacttcatattcaatcgcatttatctttgcagtcaattaatgaagacatggacagtgacgaagcgttatgtcgccgcgcgtggtgggtgctggttgttttagatagatggcattcaatgtctacatgttctcctctattccttcctgagacattcataaatctgaccatacaagatcaaaaacttttaggcactttccctagtcaacttgtacgcttatcattgatagtgggacacatttctgatgttttccagtcaccagatcctaccgatcgacaaagtccaatcgttactcaacagcttcgctctgagattgatgcttttcgtcaaagtgttgatgtcgtttggggacagatgaatttattgacattggcggttacccatgtgaaggttttattggagttgtgcatcaatgctagaccgtctactgtacttgttcctgccatgaaaatggcaacgattctttcttcgtcttctacgcctatgacaccattgaatcatcatttctttagtttagcgacatgcgttttaattggtgtctttgatttgcccgaacttcaaaatgaagctaggcgcggtttggaacacattcgtgaatgcattgaaaagagaagagacattgtaagcagagaagatcatgaagattgggattatattgtgttaaagttaattaatgccaagatgcaaggcatgcctattaactctgacccatccatacctccccatgttccaccttcatctgcttttgcttatagcaatcaagaaatggactctgctacttttaaagatgcatatttatacacccgactttgtaatttaggatatcttggctttcttatt

SEQ ID NO: 64 - protein, 867 aa, Schizosaccharomyces pombe
MDLNTLPFHSINSVNVSSAPTVNERSYPFLLDASAGVSGFNPVVSSPEKKARMKYKKNSTSPNMDVKSRKKVSRACDFCRQKKIRCDMDQSPRPGNACINCRKHHLDCNFTRTPLKRGPAKGFNRNADEKQKRASGSAKSSSPAVNGSVFSGNEASPSSRAPSITPVDSVNTTTSAIQVPSVTLTAPAPLGVDQKISQDQKPDSWLTYNAQFAQNSPQLAPSIPSPMKLSPANQQAMPPYPQMLGPGSISSYTNSNLGPSAGFRPPTFFSSPSPQPYSGPILASTAPTLDGSYLSNPSNSNPAVMSLSSNFPSPPKPNNPVYLPPRGNPTVNDRVSNVLPSITSFDSSVTTVPSNSPATLNSYTTSVPSGMSRHPMLMNPSTPEPSLGVNSPSLRPLQSLNNVQNSYRVASTQAPPPHPLRNYTSDAESISMRSKSTQASDAATFREVEQLYQENVEWDDAAIDRYYLLIHSTLPILHHSKARLKSELEKAPINLRSSCLHAIYSLVNRPPFATLGHVFHNTPMKAIGLLNLICSNVQDLSNRILHLQTMILLAIESDQRGPTTITGRNGLPQGMWLGAAIGLACNMRLHIQSHLSLQSINEDMDSDEALCRRAWWVLVVLDRWHSMSTCSPLFLPETFINLTIQDQKLLGTFPSQLVRLSLIVGHISDVFQSPDPTDRQSPIVTQQLRSEIDAFRQSVDVVWGQMNLLTLAVTHVKVLLELCINARPSTVLVPAMKMATILSSSSTPMTPLNHHFFSLATCVLIGVFDLPELQNEARRGLEHIRECIEKRRDIVSREDHEDWDYIVLKLINAKMQGMPINSDPSIPPHVPPSSAFAYSNQEMDSATFKDAYLYTRLCNLGYLGFLI

SEQ ID NO: 65 - DNA, 1191 bp, Schizosaccharomyces pombe
atggatttgcatagcattttacagcctatttctaccccttctgcttcagttgttacggcgcctcttccagctaccatcgccttaccttctcctaattattattatcctcctgtagcacaaggacattaccccgtgaacaatatgtggtctctgccttctaatgtgcgggtgatttcttctcatggcgctcccggtcatcagacttctgcatcacaaccatctactgtaatgccggctttagagaccaatgcatcaaacgcccagtactatcccgcctatagtgtaataaatggcaacaactcagtacaagttgcttcaccagcctacacagtttctcattctcctcattccttttccaatcctcgttacgttgctgttcctcaaaaatcgacatcccctaaccaggtttgttcctattgcgagcctcttccaaatcatcttactaaaactaaaagttgttctatacctcctattttgaactcatcagatagatcccctttatctttacctactccttatccagttcaatattcaactcaaccagtatctcttcctcagccaattgctgctcctgctcctccatcggctgaatcgtctaaaagcactatatctgacgaagacgtagcttggcagctaatccgtttaggggctttaagttccaattctgtcaaatcatcaccttctaaaagctttgtatctatttcaagccccgttcaatccacagttaaacctacgaaggcatctggagttgtaaaatccgaaaaagtagagaaacgttctcttcctcctcaagattttggtaacgcatcttcctctacttctgctaaacggcgtcgccctgaccataaccatacttcaactttagatgcttcgtcgtcaaatacaagtctcgcttcaactggcccaatgactgtttccagttcaacagttgaacggaagggtaaagaagcatcggaagttaatcccaattccacttcttcggttacgttttctgattttgctgctgctattagtagaagcagatgttcaaggtgtaaaaagtcaaaaaaaggttgcgatcgtcagcgtccttgcgggcgttgtcgcgatgcaggattgaattcggaagattgtataagtgatgatgatatgccagtttccaatgctcggaagcctcgaggtcgaggtcgaggtaggccgaaaacaaagaat

SEQ ID NO: 66 - protein, 397 aa, Schizosaccharomyces pombe
MDLHSILQPISTPSASVVTAPLPATIALPSPNYYYPPVAQGHYPVNNMWSLPSNVRVISSHGAPGHQTSASQPSTVMPALETNASNAQYYPAYSVINGNNSVQVASPAYTVSHSPHSFSNPRYVAVPQKSTSPNQVCSYCEPLPNHLTKTKSCSIPPILNSSDRSPLSLPTPYPVQYSTQPVSLPQPIAAPAPPSAESSKSTISDEDVAWQLIRLGALSSNSVKSSPSKSFVSISSPVQSTVKPTKASGVVKSEKVEKRSLPPQDFGNASSSTSAKRRRPDHNHTSTLDASSSNTSLASTGPMTVSSSTVERKGKEASEVNPNSTSSVTFSDFAAAISRSRCSRCKKSKKGCDRQRPCGRCRDAGLNSEDCISDDDMPVSNARKPRGRGRGRPKTKN

SEQ ID NO: 67 - DNA, 2481 bp, Schizosaccharomyces pombe
atgtcttccggcgatgtatctcgtagacagcgtgtttctagagcatgtgatgaatgtcacaggagaaagatcaaatgtgatcagagaaggccttgctcgaattgcatagcatataactatgaatgtacttatggtcaaccttttaagcgattacggcatgctcctgagaagtatatagaatttttggagcttcgattgaaatatctgaggggactggctgaagaaagcgatccaaatttaaagttgccatcatttctggctcctccaaatgacaaagattctcctgtgaaccaatctccttggaaacgctctgattcctctaaaagaagctcgtcacaggacgagtttgaaagcttattcgaccggtatggacaattgagtttaaaagatgatgggaaagccgactttcgtggaagttcctctggctttgtctttatgaaaaatatacatcaaaacattgcgaggaattctacggttcccaatcctgtccaagaatctaattcatcttcttctcagccagatcctttatcttttccgtatcttccacccacccctgccgaagatgaacataaaaaaccgcctctcaaaattcagctacctccatatgaggaggctctttctattgttagccaattttttatgaatgaccattttttggtacatattcatcatcctgcatctttctttgagaagatgcatatgtattacaaaactggcaagactgataacaattttcattttttacttgtcgctacattgtgcttgggttacacctatatgcccgatgaatctcctagtgctaactatccttatcatgaagcttacgagtattactattacattcggtcttcattttcatgggaagatagttatacgattgaagttgtgcaaattttattgtctgttgcgctttttgctttgttcagttcccgactttctcaagcttatacgttcacgaataatgcgttattgtgttgccacgaattgggattgcacaaggatttttcagacgttctcacatctcatgaatctcggttatccaaacgggtattttattctgtgtacgttttggcttgttacaccagtacaattgttggtcttcctctcagtattgaggacgttgatattgatcaatcgttacccaattcttttgatttcacattagaaaatgaccaggttcctccacgattaatagcatcagaatgcactagcttggaagtttttatacaacacataacgctttctcgtattttaagtcattttgtaaggaaagtgtatccagtcaaatcgccctctgactcacactgtaaagtttcattaccagctgttcgtgatcatgaagaaaaacttacatattggtggaaaaacttaccttcttatttaaaaatgagcgaagttccaaaattttcacccaaatggatccaagcaataatactggaattgaaattcaggcaaatagaactcattttctatcgcccttttattcacagtattagtacaccaattgataatcagaatgggtcgccaatgaaacctgcaaattttgctttaaagtgtgcacaatctgcggagcgtgttgtttttttgttacaggaattggccaaatctccaaatactcccaaactgtttttcaatttgtattctggatactacgcgttaatgaccttgacatattgtgctactttgacgaaggacgatgccaataaatctaataatttcataactaaggcaagattaggatttcattgtctacaaatgatataccgcgaatccacttactatagtacaataatggaggcaatcaagaacttgctaattgcgtatgatatgaactcatctggtactgaaaatttggatgcgaccccggatgttacaggacaactaccaaacaacttttcgcagagaactagtaatatacctagagagtttccgcaagcacaaatattttattcagatgctccttacccaggttactataatcctgcccagtttcaaaatgcaccaacaaatttccctatgcctacgtatggtgggcgtacacaggatcaatcttatcctagacaaaacggatatccttcctattctgatggtaatgtataccctcatgatagggttatgattaattatggttcttcaatgccaacagcgaatggtttttatgttccgaacacctattctccagtacctttcccgtataatacttcataccctccatacatgagtccaacttcgaatatgcctcaggctttccaagcatattcacagtatccttaccagcacccgccttttcccttgtcagaacaaatgctaccactgcctacttcaggggttatgatggcacctggagctgcaaaatctggcatgccgtatcccttcattcaaccaccttccatgactaaccaagttgcttatcctactgtccgagatggttctaataattctcctgaccatccaagttcctcaaactctaaaagaaccgag

SEQ ID NO: 68 - protein, 827 aa, Schizosaccharomyces pombe
MSSGDVSRRQRVSRACDECHRRKIKCDQRRPCSNCIAYNYECTYGQPFKRLRHAPEKYIEFLELRLKYLRGLAEESDPNLKLPSFLAPPNDKDSPVNQSPWKRSDSSKRSSSQDEFESLFDRYGQLSLKDDGKADFRGSSSGFVFMKNIHQNIARNSTVPNPVQESNSSSSQPDPLSFPYLPPTPAEDEHKKPPLKIQLPPYEEALSIVSQFFMNDHFLVHIHHPASFFEKMHMYYKTGKTDNNFHFLLVATLCLGYTYMPDESPSANYPYHEAYEYYYYIRSSFSWEDSYTIEVVQILLSVALFALFSSRLSQAYTFTNNALLCCHELGLHKDFSDVLTSHESRLSKRVFYSVYVLACYTSTIVGLPLSIEDVDIDQSLPNSFDFTLENDQVPPRLIASECTSLEVFIQHITLSRILSHFVRKVYPVKSPSDSHCKVSLPAVRDHEEKLTYWWKNLPSYLKMSEVPKFSPKWIQAIILELKFRQIELIFYRPFIHSISTPIDNQNGSPMKPANFALKCAQSAERVVFLLQELAKSPNTPKLFFNLYSGYYALMTLTYCATLTKDDANKSNNFITKARLGFHCLQMIYRESTYYSTIMEAIKNLLIAYDMNSSGTENLDATPDVTGQLPNNFSQRTSNIPREFPQAQIFYSDAPYPGYYNPAQFQNAPTNFPMPTYGGRTQDQSYPRQNGYPSYSDGNVYPHDRVMINYGSSMPTANGFYVPNTYSPVPFPYNTSYPPYMSPTSNMPQAFQAYSQYPYQHPPFPLSEQMLPLPTSGVMMAPGAAKSGMPYPFIQPPSMTNQVAYPTVRDGSNNSPDHPSSSNSKRTE

SEQ ID NO: 69 - DNA, 1680 bp, Schizosaccharomyces pombe
atggttgggaaatctaaaaatagggcccacaaaaatattcgagctagatcttgtctgagatgcaggcgccgaaaagtcaaatgtgaccgccaatatccttgttctcgatgtaaagagagtgaagaatcatgtacatatggagtaaacgagcaagcagtccaacttcttgaagaacctttaagccgaccaattactagagaaacagatagttctgctcatcaagagactcggacgcgtttggaagaaaacaacctccctaaaacccagaagtttggattcgtagactggaaaacaattttgaaatcttcggctgaatttcaaggtattgttcagagagatccagaatcacgtttaagagaagctttagaaacggatcctaaattgaaaaaacgattagaatgtattttagaaactatccctccttgggatgtatgcgaaagccttttaaaagtttatgctaatacttttaatgtaacaaattatattttagattttgagcaagctgataaattgttatctgatctgaaaaattctaaccatgttttcgcgacttctattattttaatagttacagcaattgcggtagcactttcgttagaatcctttccttcaaatattgaaagatacttttcggctgttaatcatagcgccattgaactatcggatgcattaaattcaaaaattgatgactttttaaatgaggaggtaatatttcgactatggagaaatattgacagaattcgactgcatgctataagggcgcaactttgcatgcgaaaccagtttcgaagtatgaacactgatctatgttatgcaattcattacgcatgttttgttaatccaatctttcaaaatactgataccgagtatgaagcaaatatggaggtttggctttcgatttgtgagatagatgctttggaatgtgttttacgatcttgccagccttgggttcagcacgatatttacggcaaacttctctctcagcgaaaaatgggttcagatgttattagttatgagtttcactcactactcgggcaattgttaacttgtggtttggaaatatataaagctattcatacttcgactgtaaacgaattcgttaactctattcagttttatgaaagtcaactatcgctggttttaatggaaatagagtcgaagttttctaatatcgatggatcagatattcattttcgctatttatttctcaaaaccgtattttggacagtacgtaaaaatctttatcaaggttttattactgtgagccgtactttagtacccaattatccagatattgttcaaaagcttggccaaacatcgatacagttgtcacgattaattagcaattcaatggattgtttcgaaaaatacggttggctgaaagcaatgttaattttagttacacatacgtttcttataatacatgtttgttccgaaaggggttacgatgtcccaaaggatttttggaatgtaactgcatcagtacaggctacccttgaggaaaagaaatatccgggaattgtatgggaaaggattcattacgttctgaatatatacacgacaatcaattcggtagaaccagagctctcagaagaccatggagatttggacgaccaaaacctttttcaggtttttaccgacatatttgattttaattttaattttccattaccaaactta

SEQ ID NO: 70 - protein, 560 aa, Schizosaccharomyces pombe
MVGKSKNRAHKNIRARSCLRCRRRKVKCDRQYPCSRCKESEESCTYGVNEQAVQLLEEPLSRPITRETDSSAHQETRTRLEENNLPKTQKFGFVDWKTILKSSAEFQGIVQRDPESRLREALETDPKLKKRLECILETIPPWDVCESLLKVYANTFNVTNYILDFEQADKLLSDLKNSNHVFATSIILIVTAIAVALSLESFPSNIERYFSAVNHSAIELSDALNSKIDDFLNEEVIFRLWRNIDRIRLHAIRAQLCMRNQFRSMNTDLCYAIHYACFVNPIFQNTDTEYEANMEVWLSICEIDALECVLRSCQPWVQHDIYGKLLSQRKMGSDVISYEFHSLLGQLLTCGLEIYKAIHTSTVNEFVNSIQFYESQLSLVLMEIESKFSNIDGSDIHFRYLFLKTVFWTVRKNLYQGFITVSRTLVPNYPDIVQKLGQTSIQLSRLISNSMDCFEKYGWLKAMLILVTHTFLIIHVCSERGYDVPKDFWNVTASVQATLEEKKYPGIVWERIHYVLNIYTTINSVEPELSEDHGDLDDQNLFQVFTDIFDFNFNFPLPNL

SEQ ID NO: 71 - DNA, 1575 bp, Schizosaccharomyces pombe
atgacatcgacatctcattttgtagctagtactgtgaaaaaaccaagatcgcgatacggatgtttaatctgcagaagcatgcgcaaaaagtgcgatgaggtgcatcctcaatgtggacgttgtcttaaagctggtaagcaatgtatttggaagcagcctggcactgaaagaaagaacaagacgaaatggagaaaagcaatgcagaacaactcgatcccaattcaggatttagctgatgatttcgagcttgattttcctgatactttagacctaacgaatcctgatgctctcccggtacttggtgaatcaattgttaatcctatatccttaccggtggacgtagcgtctccatttttaccctctgaatgttacccatcaaaagtcgaattgccctactttcctctcctttctaaaccgaataccttattaagtttattaaacgatgaagaaatctcctgttgcgagtattattgctattcagtagcacccatcaccacgattcttccgggtcaaccaaattttttacctcaattacttcttcctatggctttgcacgaagaatctgttttgtatagtttagtggcttcgggatacaggttgaaatacggaaacgataactctttggcacttcaaaaatccaaagtttttgtgaatcgtgcattgttaactctaccggaacgtcgatctttaaatctctcaaaatcggaatttgtagtatctttagcttgttatattcttttggtttatacggaaattgcatttgccgatactacggaatgggcaacatattttttaaatgcgtataatatgattaacaaaatgggcggctttaaaattcttaaagagtgctcatcggaaggaaaacttttagcagaatgcttcgcatactttgatatattagcatcacaatctaatttgaatgggacatattattcaatatctgattatactgatgtctacggggtcgacgagctacaattatttgaatcattggaaaactgtatcaagccgttagtactaattattggagatatcattaatttattggttgaatcccgccgtgctggattcgatgatttgcaacacacattaaacatctatgaaaaatcacaaacaattgaaggaaaaatttggtcatgcgtaccacagtacgaggatatgaaatctaacaaacttgattctgaaaaatcggaacctttgcaactttttaagctttataaaacaacaacagagatgtacctcagacaagtgatcagtcggatgcccccagtttctttagaaatgcaagtgcttttgcataaacaaactcaacttattgatttgttactcgagtcatctctaagaaactcactttcctttcccatgctgattgcgggactgaatgctgcaactgatttacaacggaccaattttaaaaatagagtaaattgtctttgccaaaattatacaattggtagtctcaaaaaggtttggattgtggttcaggagatttggaagatgaatcaaaatgggaatatttgcattgactggtatgaggtggttcaaaaattcggatggaggttaaatactggtgta

SEQ ID NO: 72 - protein, 525 aa, Schizosaccharomyces pombe
MTSTSHFVASTVKKPRSRYGCLICRSMRKKCDEVHPQCGRCLKAGKQCIWKQPGTERKNKTKWRKAMQNNSIPIQDLADDFELDFPDTLDLTNPDALPVLGESIVNPISLPVDVASPFLPSECYPSKVELPYFPLLSKPNTLLSLLNDEEISCCEYYCYSVAPITTILPGQPNFLPQLLLPMALHEESVLYSLVASGYRLKYGNDNSLALQKSKVFVNRALLTLPERRSLNLSKSEFVVSLACYILLVYTEIAFADTTEWATYFLNAYNMINKMGGFKILKECSSEGKLLAECFAYFDILASQSNLNGTYYSISDYTDVYGVDELQLFESLENCIKPLVLIIGDIINLLVESRRAGFDDLQHTLNIYEKSQTIEGKIWSCVPQYEDMKSNKLDSEKSEPLQLFKLYKTTTEMYLRQVISRMPPVSLEMQVLLHKQTQLIDLLLESSLRNSLSFPMLIAGLNAATDLQRTNFKNRVNCLCQNYTIGSLKKVWIVVQEIWKMNQNGNICIDWYEVVQKFGWRLNTGV

SEQ ID NO: 73 - DNA, 2229 bp, Schizosaccharomyces pombe
atggggaaaccaaaaagaattcctagagcttgtgacatgtgtagaaaaaggaagattcgctgtgatggaaagcaacctgcatgttcgaattgcgttagtcacggaatcccatgcgtatttacagctagacctaaaagaagaacaggtcagagacaaatgtacattaagtcgctcgtttctagattagaacaaatggagtctactctgagatccgtaattccgaactacgaccagcagcctgatattatacatccctcctctactcccaaaaactatcatgatctaaactgtacgaaaggcgaaacttcttccgatgactccaccgacgatatagcgtttttgaatgaaaaaatggggactctcgtcactactccgatcggttctcaaaaatatttcggctcttcatctaccttttccattattcaacatgctgcaaaatttgcatcaggagttgaatccgataaagttttagagcatctgtccatggctaaatcgggttgtttgtttgatcctgatgagagtttcgatggctcaaaagccgaattaccttcttcagagattgccaatatatacatagatgcctacttcaaatcatacaatcctttatttcctgtttttacaagagaaaatttttaccaaaaatttggttccccaaattgtttcaaaaaacccgatggttccattgatctggttaattatgcttcatacgttgttgttttatctcttggttgtcttgctatagcggatactgaagagcaagtttcccgagctaatgctctatttaaaaacactctcggaatcagtattgaagttactaaagatatgagcttccgtactctggtcttcaattttcttacttcagtctattattgcgcagtttccaaaccaaatgcggtctggttgaacgttggtgtagtcgttagagttgcacaaacgctaggtcttcatcgaaacagtgcaatgtggtctattggaaaggaggatgcggaagagaaagctcgtttgttttggtatatatattatttggatagagtatcctcgatgatgacaggaaaacccgttgcttttcaggacgatgacattgatcaaatggtgccattttactctatttattgctattatggacttaagccacccgaaggagatcctttgggtacttttaactttttggaagccgaggtgcagttaacgcgaattgttggccaagtcctaaaggaactatactcagtgagtggcatgaagtctaattcttctcaagttatggaaaaaatacttgagtttgaccttttgctaaacaactggtataacagtcttcccgactgtatgcaacctcggaatcgttttaaaattcccaaattttgctcgagcaatctgattttaacatctgctatttattattcatgtttaatccttattcatcgtcattctcttacaaaaaatcttcaggtgaattgtgtccatagagggactggctctataacagattctcaagctttatgcattgcggcagctcgctccattacaaatcttttcgtggaatcggttgatctacagccattgataatgaaaatcattatgtatcatgcctttacatcttcgattatcatctttatcagtatattgaagcggcctcttgcttctatatgttctgaagatttgaattgtttaatttccgtaaaaaatcgtttaataagttttgaaacacatggttttgttcgtttgaatgtcgttatggatgctttagaaagtatgatctcgactgctcaggcagctatgcaaaaggctaagcaaatagcaatcaattttagcagcaacttagctacgaacgaagatgttactaattctggcatgcctgatattgcggatgtttccctaaaatcgcaaagccatgtaccaccacgtatatccagcaaccattcagatacaagtgttaaaagcaattctccctcctctatatttgataacagcgggtatctgaactctcttaataacagcatcttacaaatgcatcaaaacctccaaaattcatctaacacaaatgaccagtataagtttgattctgttcaggaaaatgagctacatgcaaatataactcccgtgttagatcaaacaatgtcaatgttcccgtttaaggatcagttagatctaaattttgctgctgctaatgtttacaatcctaatgtttttgatgatatgggtttggattgtagtttttatgggaacggtcta

SEQ ID NO: 74 - protein, 743 aa, Schizosaccharomyces pombe
MGKPKRIPRACDMCRKRKIRCDGKQPACSNCVSHGIPCVFTARPKRRTGQRQMYIKSLVSRLEQMESTLRSVIPNYDQQPDIIHPSSTPKNYHDLNCTKGETSSDDSTDDIAFLNEKMGTLVTTPIGSQKYFGSSSTFSIIQHAAKFASGVESDKVLEHLSMAKSGCLFDPDESFDGSKAELPSSEIANIYIDAYFKSYNPLFPVFTRENFYQKFGSPNCFKKPDGSIDLVNYASYVVVLSLGCLAIADTEEQVSRANALFKNTLGISIEVTKDMSFRTLVFNFLTSVYYCAVSKPNAVWLNVGVVVRVAQTLGLHRNSAMWSIGKEDAEEKARLFWYIYYLDRVSSMMTGKPVAFQDDDIDQMVPFYSIYCYYGLKPPEGDPLGTFNFLEAEVQLTRIVGQVLKELYSVSGMKSNSSQVMEKILEFDLLLNNWYNSLPDCMQPRNRFKIPKFCSSNLILTSAIYYSCLILIHRHSLTKNLQVNCVHRGTGSITDSQALCIAAARSITNLFVESVDLQPLIMKIIMYHAFTSSIIIFISILKRPLASICSEDLNCLISVKNRLISFETHGFVRLNVVMDALESMISTAQAAMQKAKQIAINFSSNLATNEDVTNSGMPDIADVSLKSQSHVPPRISSNHSDTSVKSNSPSSIFDNSGYLNSLNNSILQMHQNLQNSSNTNDQYKFDSVQENELHANITPVLDQTMSMFPFKDQLDLNFAAANVYNPNVFDDMGLDCSFYGNGL

SEQ ID NO: 75 - DNA, 2445 bp, Schizosaccharomyces pombe
atggataatgaatctcatagtcaggaaaccgaaagcaagattcttgaaggcgccaaagtggctacccgacgacgacgtgtcactcgggcttgtgatatgtgtcgtcgtaaaaaaatcaagtgtgatggtttgcgtccttgtaagaattgcaaagctggcaaattagagtgtacttatcacatgccttcctctcgaaagtcctcattttcgcccgagtatgtggaaaatttggaatcccgcgttcggtatttggaaacgctgttgaagaaaaatacaaactttgatctctcctctaactcacccagtttcctcttctttttgagggaacaaaaatttcaagccactaacgagcttgaaaacatgtcaccagaacgaaaggtaatctttacttccatgattaattatggcaatttgttcgttgacgcgaagcatggaactagatattttcgtggtggttcttcaattcacgtcctcatccaacatcttattcgacgcttacccggcgatttcgaaatatgtgagccttactcagcctaccctttgggcaataaaaatattcaattcgatgataatgatcctgaataccaattctttactcctactcctagattcagcatcgactttatggtgtctagcgttgatcctcgtgagattcagctcccaggaattgaagaggccttgtgtatcactaaagccgctgttagctacgttagcggtatcgttttttatacgacctatgccgatttccccaaaaagattcgtcttttatattccggtaattatcaaggcaacttttttccactatttttatctattttgtgtgtaggttactatcatcatcttcttaataaccccagtaacaccgagttacaaagtttaatcaaaaagtacagtttttacagcgaacgattagtgaaatccgcggataactttactattgaaagcatccaatgtctcttaattcttagtatttatcggtattgccgaaccgaaattagcgctgcctggtattacatgaaactaggtttgaattgctgtcttaggttaggtctacatagaaatattacagaaggatttacggaggaacaaattgatagcagaagacgtattttctgggcaatttactgttatgaccggcagttgtgtactttgtttggatttccgttgggtgttcgtgatgaagacattgatcagtgtttacctgtaacaccaaagttcccatcggtaacggaaattgaagcaaacgcacgattgtttttctttcatggtgtgaagctttacaagatttcaagtcgtatattgaccaagctatattccccaaattcacgaaacgtaacaaagaagcacatttcatatgctgtaatccaagatttggagcaactattggatggtttttacaattctcttccccgagtttttagggccgagcaacctggagaatttcaggcaaatcattttttctacaacttacagttggtgtattattcttttagaatgttaatctaccgacctctcctacattaccttgaagctgacagtccagcaatgcaagcacttaaggtgccagatcgacaaaccgccttcactttggcgtgtaaatgcgtcgactctgctattgtatgtgttcaaaatttaagtcacctttccaagggtcttaaacgtacgttagacagatattactggactaccgtttattgtggatttagcacaattgttacacttatttttgcagctcttttaactaaaaataccaacttactgattcatatttctgtcgcccgagaatcaatagaagcattggctcacgaatgcgtcaccagaagacttttaccattgattgacaaaatgagagagtcactcatgaagattctcgaatccaatgcggatggatataaacagatgtcaccaacaaaagctcctcaagtatttgaatcggaatcgaatgttcctattaataatgggcctcaacaatcgatagataaagagagcaattctaacactcaattaccacaagttgagacggagggacaacaacaatccgtttttgatggaaacataggaacaataccttatcaagcatacaacatgaatgaagattcttttatcgatatcaacacattatcaagcatgctaaattaccatacacaggctgtttcaatccatcacccctcgttttacatttcacgcagtgatgtaccattggaagaagaatttcagatccctaacgaactgctggcagtggatcctgtagcagaaagtatgcaggaaaattcggatataatcaatgaagcttttggtttagtggatcctgatgtgtctgacggaaaatccagagagtcgagttcacttaacaatagcacaccctttaatccgactgtaaatattgatcctgcatcaatcttggagcatttttctcaaaacgttatgaaagactcgcaaaatagt

SEQ ID NO: 76 - protein, 815 aa, Schizosaccharomyces pombe
MDNESHSQETESKILEGAKVATRRRRVTRACDMCRRKKIKCDGLRPCKNCKAGKLECTYHMPSSRKSSFSPEYVENLESRVRYLETLLKKNTNFDLSSNSPSFLFFLREQKFQATNELENMSPERKVIFTSMINYGNLFVDAKHGTRYFRGGSSIHVLIQHLIRRLPGDFEICEPYSAYPLGNKNIQFDDNDPEYQFFTPTPRFSIDFMVSSVDPREIQLPGIEEALCITKAAVSYVSGIVFYTTYADFPKKIRLLYSGNYQGNFFPLFLSILCVGYYHHLLNNPSNTELQSLIKKYSFYSERLVKSADNFTIESIQCLLILSIYRYCRTEISAAWYYMKLGLNCCLRLGLHRNITEGFTEEQIDSRRRIFWAIYCYDRQLCTLFGFPLGVRDEDIDQCLPVTPKFPSVTEIEANARLFFFHGVKLYKISSRILTKLYSPNSRNVTKKHISYAVIQDLEQLLDGFYNSLPRVFRAEQPGEFQANHFFYNLQLVYYSFRMLIYRPLLHYLEADSPAMQALKVPDRQTAFTLACKCVDSAIVCVQNLSHLSKGLKRTLDRYYWTTVYCGFSTIVTLIFAALLTKNTNLLIHISVARESIEALAHECVTRRLLPLIDKMRESLMKILESNADGYKQMSPTKAPQVFESESNVPINNGPQQSIDKESNSNTQLPQVETEGQQQSVFDGNIGTIPYQAYNMNEDSFIDINTLSSMLNYHTQAVSIHHPSFYISRSDVPLEEEFQIPNELLAVDPVAESMQENSDIINEAFGLVDPDVSDGKSRESSSLNNSTPFNPTVNIDPASILEHFSQNVMKDSQNS

SEQ ID NO: 77 - DNA, 1641 bp, Schizosaccharomyces pombe
atggagtatcatccttcttctcaatctcctcaggtaaatcctggaatggaatcccagcaaggcggttatacgtacacttaccaacagccagcacctccaaattcattgcatcttcagcatccctcaatactaactcgacttcccccactctcctcctccgtagtttctccttctctcgcttcattgccgccttttactcctacatcaacatatcattccattgcagctctaactccaccctcctacccccagagttcttctgccccttctaataattcatacaccatagtgccttccccccatgacccatcgaatgcctatagcatgcatcatgtccttcaaaatactgctcctcagtccgttccatctccttctcccatcgagatggtccctccctcacctccaaaaactggctcaaataatagtgctcctgttaccggtaaaaccgtgcaatcagggaatgctcttaataatagtgggttggttaaacgccaagctagaaaaagaactaaaactggttgcttgacctgtcgcaagcgaagaattaagtgtgatgaacggaaaccgatttgctacaactgtatcaaatcgaaaaggcaatgtgagggttatactcatttccctcgcccctctggcacatttacggcatctcgaagaatccctgtttccagtttattgtcagagccagcgccacatggtttagctggccaacctacacatcccacatttctttactatatacaatcggtggctccttccctttgtctttgggatgcatgtcactttccccctttaagtccatattcttcattttcaagtatatattggtcatcaactgttcctgaacttgctttaagaaatcccaatattagtgtagccctctatgctttcgccagcgccaagcgtcatctaacggatgatgccgtagcttttgcacgtcaagcccgtgttgcgcttaccaacattactaccactgacagtcttctcatcttagtcttgctagcagttacccaactatacattccaaaaagcgatatccaactcttcaattttgctgttgatcaagtagtcaagtttgatgcatctttaatgactagccctagcgatgaaattattacttatttattgcgccgtatgtttattcgtcaagtggtattggctggaattgtgaagccattagcatcgggtttgaatccattgcctttactcaaatgtgatttgccccctgcaactacacctactgctgttctcgatgaatctcttttccaccttggtttacgaaagctttgtcatgaaaagggccttgagcccgagtttactaagtggtcgaaaaattgccctatagataaggctgatttaccccgcctggctctactgatgattcacgccgttttcacctctcctgtatcattagctcaatgggttgaattgatccttcaaaatcctgacccaacacccgccattcatatcgcgagagcgtgcctattagccgttcatggcgtcgttgatttgggtgatttacaaatgaaagttgagaaatgtgtacaatcctgtgaagaacgccaacttcaagctaccatatcgaacttttcaacagaagttgctcaaactaattcttccgctttagccattggttgtcaa

SEQ ID NO: 78 - protein, 547 aa, Schizosaccharomyces pombe
MEYHPSSQSPQVNPGMESQQGGYTYTYQQPAPPNSLHLQHPSILTRLPPLSSSVVSPSLASLPPFTPTSTYHSIAALTPPSYPQSSSAPSNNSYTIVPSPHDPSNAYSMHHVLQNTAPQSVPSPSPIEMVPPSPPKTGSNNSAPVTGKTVQSGNALNNSGLVKRQARKRTKTGCLTCRKRRIKCDERKPICYNCIKSKRQCEGYTHFPRPSGTFTASRRIPVSSLLSEPAPHGLAGQPTHPTFLYYIQSVAPSLCLWDACHFPPLSPYSSFSSIYWSSTVPELALRNPNISVALYAFASAKRHLTDDAVAFARQARVALTNITTTDSLLILVLLAVTQLYIPKSDIQLFNFAVDQVVKFDASLMTSPSDEIITYLLRRMFIRQVVLAGIVKPLASGLNPLPLLKCDLPPATTPTAVLDESLFHLGLRKLCHEKGLEPEFTKWSKNCPIDKADLPRLALLMIHAVFTSPVSLAQWVELILQNPDPTPAIHIARACLLAVHGVVDLGDLQMKVEKCVQSCEERQLQATISNFSTEVAQTNSSALAIGCQ

SEQ ID NO: 79 - DNA, 2571 bp, Schizosaccharomyces pombe
atgtgtccctctgacttttctagtcgttctttgtttttagaagccaaagaggaagagtataaacaaagaaggcgtgttcctttggacagtagaagaagagtaaggcgggcatgtctgtcttgtcgggccaagaaaattcgatgcagtggttctgaaccatgtcaggcttgcattgctacgccttcgcaatgtaagtatgctgattctttaaaagagcgtactccctcaaaacaatttattgcggaactgagtcaaaggcagaaatgcttcgaatatctgatggaattgctgtgtccttctcttcctcatgacacacgtagtttagtcaaactatgcaaacatgtcgaatcttcattagcttctggaagcgacgttcgttctttgctaatacccgggtcaattgatcaatctgttttaaaggttgctgctacaaacaataaagacgattcgtctgctgtcaagtcagcaaacgtttcttttccttcttcatctactcccccctcttcggattcaaatttctcatctattcaaaacactgatcttaatacttccatcaagtttactgaaaatatatctgctaatgcaattcatgtgaaccaagataaggttattagaagtgccaataatttaataatcaattcccaacccatacttcctgtacgttcattcttagatgctctaggagaacccatatatttaagtccgacgtcaagcacttattttttaaattctgttttagcatccttacagttaaattcaagcaataccccagaatcactgctcattgactatcaaagtaaaattccggaggatctctcttcctctttattgcctttagaactaaacacacttcaatcgacccctacttcagtatctgtaggttcagcttcttcacaaggaactcatgaatattcaattataaatttgacctccaatcactcatctttttcattaaaagctctaaagaaaatagcacataatttgttaccaccggtttctgtcgcagaacgttatgcaaatgagtttttcctccggtatcaaagttttttttacttttatcctccatctgttttttctaaccgttaccaaatccttgcagatggtttagttaactcagatacgttggatacaggatttcttgctgttgctcttttaattgttgtgcttggtcacttctcaaataacaacattaatgtattgcccaaggaagttcagcttagtcatattgattcaatgatacagatttcagagcaattaattagctctttattaaatcgctgtaccctttcttctattcaagctgtctttttactttcactatatcattttttaactggaaattttaaatgtgcatattcttatttaggttttgcaatacattccgcgcatacccttggtttggagcatggttcaactgataacagcacattaaatgaagtttcaactgaggagactagtattcgcatatgctggtccttacgtgttttagccagttttttgtacatacagtctggaattactcctatcataaatttatttccaaatggtctgaattctttaaaacttcctaccgttgtcccggagctggaggctcgacatttaccttcatccgtttttcattttgtcgctataataaaatacgctgagatctccgtacggtctctaaattcactgtatgaatcaagttctgattatttgatggatgtctcaaattttcctaaattactattaaaagttgaaagaatctactcccaagctcgtaattggaagttaaacttaacccatcaacagcttaatggaacgaatgacacttcagatctcctttttcattccaacgttagcttacatttattttatcactacctaattgtcaaggtaagttgtcccattatgtttttctatttaaataattggtattctgttaaaccttcttcatttacgaaaggccttaacaataaaccaagcttggaagatgtgttttccaatttggaaacctgctatgagtctgcaaaggcaattgttcagttatcatcgaaattgttatctgctggtcagatggacaagtgtttttatttggagtttgaaattttatactgttcggcaattgtgttatttttattctcagttatgcaccttggtgcagaaaacccattacttgaaagtatttatttactggaagatatgggatcacgtactatcgattcaaaggttcgacttgaaaagcttaagagtgcaatcgaaatatttgatataaactcagctactgaaatgcctataaacgagccattatccgcttcttttgaatcagtcaacaaagaaaacagccagagtggatatatggcttggcaaaattgggttacagaattaagctcgtctaacattcctttaggtcatgctttgggtaatcctgagtcgaacaattcatctaactcgttcaaaccttctcatccatctcaaagttttttggtcaatgaatcactcgatttttcttcgaatcctaaggagcctccattccttccgtggtccgaagcattgctaaatatggatatgcaattgaatcgtttaggacca

SEQ ID NO: 80 - protein, 857 aa, Schizosaccharomyces pombe
MCPSDFSSRSLFLEAKEEEYKQRRRVPLDSRRRVRRACLSCRAKKIRCSGSEPCQACIATPSQCKYADSLKERTPSKQFIAELSQRQKCFEYLMELLCPSLPHDTRSLVKLCKHVESSLASGSDVRSLLIPGSIDQSVLKVAATNNKDDSSAVKSANVSFPSSSTPPSSDSNFSSIQNTDLNTSIKFTENISANAIHVNQDKVIRSANNLIINSQPILPVRSFLDALGEPIYLSPTSSTYFLNSVLASLQLNSSNTPESLLIDYQSKIPEDLSSSLLPLELNTLQSTPTSVSVGSASSQGTHEYSIINLTSNHSSFSLKALKKIAHNLLPPVSVAERYANEFFLRYQSFFYFYPPSVFSNRYQILADGLVNSDTLDTGFLAVALLIVVLGHFSNNNINVLPKEVQLSHIDSMIQISEQLISSLLNRCTLSSIQAVFLLSLYHFLTGNFKCAYSYLGFAIHSAHTLGLEHGSTDNSTLNEVSTEETSIRICWSLRVLASFLYIQSGITPIINLFPNGLNSLKLPTVVPELEARHLPSSVFHFVAIIKYAEISVRSLNSLYESSSDYLMDVSNFPKLLLKVERIYSQARNWKLNLTHQQLNGTNDTSDLLFHSNVSLHLFYHYLIVKVSCPIMFFYLNNWYSVKPSSFTKGLNNKPSLEDVFSNLETCYESAKAIVQLSSKLLSAGQMDKCFYLEFEILYCSAIVLFLFSVMHLGAENPLLESIYLLEDMGSRTIDSKVRLEKLKSAIEIFDINSATEMPINEPLSASFESVNKENSQSGYMAWQNWVTELSSSNIPLGHALGNPESNNSSNSFKPSHPSQSFLVNESLDFSSNPKEPPFLPWSEALLNMDMQLNRLGP

SEQ ID NO: 81 - DNA, 1782 bp, Schizosaccharomyces pombe
atggtaccaataaaaaaaattagcacagcttgcgacttgtgcaggcaaagaaaacttcggtgtaacggcgaattgccaaaatgccagaattgtgtagtgtactcagaaacgtgcaagtataataaaagaaaaagagtaaagaagccaaacgtagacaaggatgacccacatatcgtcgtcgggcagccgcctgtaaagaagtcaacagctggtattactcgagagtacaccgaaatgattgaactgagaaatcatattataacgttaagcaaaagatctgttaatatggaatctcggattgacgatatgctaaatttgctcaactacgatctgtcagaaaagagagaaacgtcgaacgagataccatcgcttgtacagcaaattcaaaactgcggttttctaatagatgaaaaaatgagaaggtatccagggattttccaaattcatcccaaggattacaccatgaatgatctgtttcctcaaagtttccctacatggattagtgtatatcgcaatgtaccagaaaaagcatgggccaatcggtgtgttgagtggtattttcgctatataaattcatgttggcctttatttgatttagaaaattttatggacctttttgataacttttattccgataaagaaaaaacaaaaggtgcttgggttgtctccttctatgccattatggctttagcggtgtcccgtagcaaaagaaaagataaagaaaaaatatcaaaatcgcttttctctacaagttggtttttggtccagaaacctggcttttttcttacagcgcgcctggataaaatccaagctttaacaattatgatacaattttgtgcacatttatctttatataatctttgcaaagttttgtgcggtcaaatgtgcctaatggttaaggatttggatcttcacaaagaagctacgaatcctaatgtcgacattgaagttgacgagctaaatagacgggttttttggacatgttatatattcgaaacaactacctctctgatatttggaacaccgccggaattgggtgatctagaaattgattgccaacttccatccatggatgttttgcctcggtttacagagtcaagtcaaggtggtatagtattttgttcagaaatccagttaaccattattaaaaacgaaataaggaaaaaaatatacaagtgtttagcttcggcaagtgaagaggtctataaggaagccgtattaagcattcgaggaaaactgattgtttgggaaaggaacttgccagacgagctgaaacagtactacgatgttattaaattaaatgggacaattccaaagaatgttgatttcgaaaatcaacatatatttactgcttgtgttgaaatttacttatcgtattgtattactcaactatacttttacgatcctcttacaaattatgaaacatgcctagaaattgcacggaaagctgcagatgccataagaagctacttcatggttattgaaccaatttttaaaaagatttgttacttatggttgtttctctattgtccttttacaccttttcaaatccttttttccaatatcctaaaaatggaaaaaggtaccagtgatgaaaaaatcgaggacttggatcgaatgtattcactctatcggttttttgtcgaaatgaaggagattaacggagagtttgctgacaaattatctcgcgttgctttggattgtattgatgctgcagaacattatttagaacttaaatcttctgtcggttccaacatttttgaactggagagtttgttggtg

SEQ ID NO: 82 - protein, 594 aa, Schizosaccharomyces pombe
MVPIKKISTACDLCRQRKLRCNGELPKCQNCVVYSETCKYNKRKRVKKPNVDKDDPHIVVGQPPVKKSTAGITREYTEMIELRNHIITLSKRSVNMESRIDDMLNLLNYDLSEKRETSNEIPSLVQQIQNCGFLIDEKMRRYPGIFQIHPKDYTMNDLFPQSFPTWISVYRNVPEKAWANRCVEWYFRYINSCWPLFDLENFMDLFDNFYSDKEKTKGAWVVSFYAIMALAVSRSKRKDKEKISKSLFSTSWFLVQKPGFFLTARLDKIQALTIMIQFCAHLSLYNLCKVLCGQMCLMVKDLDLHKEATNPNVDIEVDELNRRVFWTCYIFETTTSLIFGTPPELGDLEIDCQLPSMDVLPRFTESSQGGIVFCSEIQLTIIKNEIRKKIYKCLASASEEVYKEAVLSIRGKLIVWERNLPDELKQYYDVIKLNGTIPKNVDFENQHIFTACVEIYLSYCITQLYFYDPLTNYETCLEIARKAADAIRSYFMVIEPIFKKICYLWLFLYCPFTPFQILFSNILKMEKGTSDEKIEDLDRMYSLYRFFVEMKEINGEFADKLSRVALDCIDAAEHYLELKSSVGSNIFELESLLV

SEQ ID NO: 83 - DNA, 1785 bp, Schizosaccharomyces pombe
atgaaaaggatcagaaatgcttgtgaattgtgcaggcgtaagaagctaagatgcaatggtgaattaacttgccaaaattgtatggtatatggcgaagagtgtcgttatgttaagcgggttaaacatgacaatcgagcagcagtacaagaaaacgaaaggtatcctatactctacactccgctcagcacttcagatcatgataacgacgaagagaatgaaatcaatgagttgaaaaatgctgttaaagctttggataaacgttttgataatttcgaattaaagctagaggctcttttctctttattaagatctcagcaggactcagagaggaaagtgaaacccgggggttttccatctttggtttcacagattttgagtgcaggggctctcgtggattcaaaattgcaggcatacactatgagaaccaattttttttctaatggatttagcagcaacgatttattcccccatagctttcctacttggaaaagtgcctttcgagatgttccagacaaagattgggctaaaacatgcttggattggtatttcagatttatcaattgtaattggcctatattttataagaaacagtacatggaaagctttgaaaagttatatatagacaagaatttggtcaagggtgcctggattgtctcgttctatgctattttggctttggctgtatctcgagacaaaagagtcgataatagtaaattggcggagtctttttttgctacttcctggtttctaattcaaagacctggcttttttctcacaccgcaactcgaaaaaattcaagcattagtgatcatgattcagttcgcaagtcatctgtcgttgtacaatctctgcaaaaaactttgcggtcaagtttgtttgatggttaaggatttaaatttacacaaagaaagtacagacaaagatcttgaccaagatatggcagaattgcatagacgaatattttgggtatgctacatttttgaaactaccacatccttgattttcggaacccctcccgttttgggagatctggaaattgagtgcaaataccctgacattaattatgctcattgttttgctgaaaacgtccaaggagatttaatatttacatgtgaaatatcgttaaccgttttgaaacacgaaataaggactaagctctacaatagtaataatgtttttttagacaaaggtcaaaagggtgtgatatctaacattcaaacaaagatattgaattttgaaagagccattccttctgaaatgaagcattattttgagatacttaaggcaggtaacgggctgcccgaagaactggatattattaagcaacatttttttacagcttgcgtggaaatatatctgtcatattgcaatacacttatttatttatatctcgcggacgatagcattgaaggatcaaaaatttgtttaagcacggctagagcagctattgacgttattaagggatttttggtggttcttgatcctatttcaaaaaatatttgttatctttggctgtttctttattgtccgtttacaccttttttgacggttttttcacatcttttggaagacgacgacttggacgctgatatatgcgtcaaggacgttgatcggttatactctattcatgctttttttttaaaaatgaaagatatcagtggagaatttgctgagaggttatcagttattactgagaattttattcaatcggctgagcaatatcttgcgctgcaaaatacaagtgtgtttgggacatttgatgccttgagcgaaagtttttcaatt

SEQ ID NO: 84 - protein, 595 aa, Schizosaccharomyces pombe
MKRIRNACELCRRKKLRCNGELTCQNCMVYGEECRYVKRVKHDNRAAVQENERYPILYTPLSTSDHDNDEENEINELKNAVKALDKRFDNFELKLEALFSLLRSQQDSERKVKPGGFPSLVSQILSAGALVDSKLQAYTMRTNFFSNGFSSNDLFPHSFPTWKSAFRDVPDKDWAKTCLDWYFRFINCNWPIFYKKQYMESFEKLYIDKNLVKGAWIVSFYAILALAVSRDKRVDNSKLAESFFATSWFLIQRPGFFLTPQLEKIQALVIMIQFASHLSLYNLCKKLCGQVCLMVKDLNLHKESTDKDLDQDMAELHRRIFWVCYIFETTTSLIFGTPPVLGDLEIECKYPDINYAHCFAENVQGDLIFTCEISLTVLKHEIRTKLYNSNNVFLDKGQKGVISNIQTKILNFERAIPSEMKHYFEILKAGNGLPEELDIIKQHFFTACVEIYLSYCNTLIYLYLADDSIEGSKICLSTARAAIDVIKGFLVVLDPISKNICYLWLFLYCPFTPFLTVFSHLLEDDDLDADICVKDVDRLYSIHAFFLKMKDISGEFAERLSVITENFIQSAEQYLALQNTSVFGTFDALSESFSI

SEQ ID NO: 85 - DNA, 1530 bp, Candida albicans
atgtcagtaccactcaccaaagaaaagaaaaagagatcgagaggaggttgtgttagttgtaaaaagcttaaaataaagtgtaacgaacaaaagcctatttgtgaatactgtcgatataccaaaagaacatgtatttatcccatcttggcacccataaaaggctacagaagaaagacaagcagatcaccacaagagagtaaagacgagaaaacatcaacacctcattcatccacaactgcaacctctccaatatcatcatcgtcaacttctgataaactcaacaatttatatgtttcaaacaatgaggtaccagacataaatccctaccattacgataaattatcgcgtgacttggtattgaccaattcaaccagtatgctaggtataactagatttgaattgcgtctactacagttttttgatcaagagtgtatcaattttttttcattcggggtaaacaagaacatacacaacacttggaagtacaaagtgccctatctctttttagaaagtgagttggtgaggaaaagtatgtttgcattatcagcaatgggcttgctgacaacgttggatttggacgaactacaaagtattgacgcagatgaggatgaaaagtcgttagtcaacatttacaataccaacgtggacgaattagacaatatttttgaaaatactacaaaatattttatggacacaataagcaagaccaaacacatgataggttcaatagaagatgattctaatattgccagttttgacgatccaaaatctgctaaggaattacttgtgtcaagcattctagtattctcgtatttgggagtgcatccacatagattgctgccattgattgattttacacaggaacgaggagacctaattcagataagtaagggcattcgatacactataatgagttgtgctcccactattttgaaatctgatatgagccctcttttgttcttccatggaattgaaaaaatgcaaacgccaacatttgagaaatgccaatatcccataattcaagatttgaaaaatgatattgacgaatttggttttggcgaagggagttcagagatttcagaagaactatcaatactcaaagatgtagtagcaagattaatgatgtgcataaatggatgtaaatttttcaaattccccataccactatttcgtttcttgatgttatttgatgatcattttcgagatttgttatacaacaagcatagactcgctttacgaattttatatgtctattccgctttgtgttcaatatgtcgatttcaattttttgatgaacgtaatgtatggaaagattatatgacttggtacaggggttatgctgctgaaaattttgatggctacaaaaatgaaacggatgaatatttgtattttttggcagcaattgagcattttcactgggacgattttacgaactttgataagtttaatcctaaagcagaatttgaaaaggttatacagagtggtaaatacagaaaacaactgctacttgttggtcagaacctgaactgc

SEQ ID NO: 86 - protein, 510 aa, Candida albicans
MSVPLTKEKKKRSRGGCVSCKKLKIKCNEQKPICEYCRYTKRTCIYPILAPIKGYRRKTSRSPQESKDEKTSTPHSSTTATSPISSSSTSDKLNNLYVSNNEVPDINPYHYDKLSRDLVLTNSTSMLGITRFELRLLQFFDQECINFFSFGVNKNIHNTWKYKVPYLFLESELVRKSMFALSAMGLSTTLDLDELQSIDADEDEKSLVNIYNTNVDELDNIFENTTKYFMDTISKTKHMIGSIEDDSNIASFDDPKSAKELLVSSILVFSYLGVHPHRLSPLIDFTQERGDLIQISKGIRYTIMSCAPTILKSDMSPLLFFHGIEKMQTPTFEKCQYPIIQDLKNDIDEFGFGEGSSEISEELSILKDVVARLMMCINGCKFFKFPIPLFRFLMLFDDHFRDLLYNKHRLALRILYVYSALCSICRFQFFDERNVWKDYMTWYRGYAAENFDGYKNETDEYLYFLAAIEHFHWDDFTNFDKFNPKAEFEKVIQSGKYRKQSLLVGQNSNC

SEQ ID NO: 87 - DNA, 1440 bp, Schizosaccharomyces pombe
atgactcaaaaaaataccggtccacgtcggcgaactgccgttgcctgcgatagatgtagacgcagaaaaatccgttgtactggtagtgacattcctggacaaccttgtttagcttgtcaaaaggctcacgccgattgtcacttttcaaccacctcgtggcgtgcttgccgtaaaaagtctgcccctttacactgtccttcaacgaatggaaagaccaacgtccttccctcttatgcctcaacaccttcattatctcctatgacctcttcacatttcccttatgcatccgacggtaccttaatatcggctaccaaccattgcgatgattgctcttataatcctcactaccttcctgtgaattctaatggtagctctccatctcacacatcttcccttgattccattcctggatatgcttctgggtctggtcctttcaaaactccttatcgcccagttgctgtttctgagagttcatcaagatcctcattctccatgggatcttctgaatttgcctcatctacttggtctcaatctccaatgcaatcttcattatatgtatctccatcttctcaaccgttagatcggttttcccctgctagtttcccttccaaggaaactttgacatcctcttctttgagttcatctgtccctaggagtgtttctcttagcaactttgccgattccaacacttctaactatcctgagagctccttgttacctgctgctaaagtcggcaataatggttttgttggcagcaatgtattaggtagcatgtcatattccaacgttgaggatagcgttagatttcaaacagattcggtctctcaaatgtcaagtaagtctcttgaacatttacccatgctttctgaaatgactctttcaagttcagcttcatttggtgcatccgtttccccaaaatctactcctggtagcaatagcactggtgctgccgttgataccaacagcgttcattccaatggtggatctgatttggattattcctcgtatctgacggattcttctgctgttgattcaccttctcttgacgcagacgaagtccttcgtagcttcaatctggctaatgacccgattggagcagtagatcctcttactttggagattgaccaaggaagtggaagccaattgcttggacagcaatctttcgcaaatgacagtttgaatgccaaacaatcctctggcaaactcggtcctctacctccccaatcttttaatagctctgattacatttcattcgacgagccttctcgttatttaagtgatgacgctagcttatggccagatcaatatgttgacaaagttcagcctttagctacaatgaagacttgtaatcctgctgttttctcttcaaatacatctctggatgatatgtttttctttattcgtgatttcgatgaggatcatccaattcaaactgcatat

SEQ ID NO: 88 - protein, 480 aa, Schizosaccharomyces pombe
MTQKNTGPRRRTAVACDRCRRRKIRCTGSDIPGQPCLACQKAHADCHFSTTSWRACRKKSAPLHCPSTNGKTNVLPSYASTPSLSPMTSSHFPYASDGTLISATNHCDDCSYNPHYLPVNSNGSSPSHTSSLDSIPGYASGSGPFKTPYRPVAVSESSSRSSFSMGSSEFASSTWSQSPMQSSLYVSPSSQPLDRFSPASFPSKETLTSSSLSSSVPRSVSLSNFADSNTSNYPESSLLPAAKVGNNGFVGSNVLGSMSYSNVEDSVRFQTDSVSQMSSKSLEHLPMLSEMTLSSSASFGASVSPKSTPGSNSTGAAVDTNSVHSNGGSDLDYSSYLTDSSAVDSPSLDADEVLRSFNLANDPIGAVDPLTLEIDQGSGSQLLGQQSFANDSLNAKQSSGKLGPLPPQSFNSSDYISFDEPSRYLSDDASLWPDQYVDKVQPLATMKTCNPAVFSSNTSLDDMFFFIRDFDEDHPIQTAY

SEQ ID NO: 89 - DNA, 2301 bp, Schizosaccharomyces pombe
atgcatgctaggatgcagccccatgaggataggagtcgtagtggcatgagtagaagcgaagctatggagttggaggatcaactagaggaagaagaaaggggtggtaatgttgttgttggcagcagcagcgcgaacgcgaacgcgagcacagcagaaactgggaagaagagcgctggaggctcaaaaccgaaaagaagaagaggcgagcgaattccaccttcaaaaaggattcgaaaagctattgcgtatgtaaataaatatgcatctggttgttttggtcgagttgaaagacgtttagtttgtacgcgttcgatcagccgccattccaaccaaaagttgcttgatttttgtgtggaatgcaaaaagcataaaatcaaatgcgtcggtaactttccctgtggcagatgtcttaaaaaaggattagaatgcgtaatagaaactcctcctagattgcttatgaataaagacgaaatttctctcaatcttcagagactcagtcatatggagaccatcctttctaaactcatgccaagtatgagcttggatttgcccagcttggaagcaaagattgcggagcttagtgaaagccttcaaacctatcctgataaagtacttaccgacatcgaacttggaagctatcaacaagtgactttgaatgagacacagacatattacgaagatgccggctctaacgaaagcttcgtcgctcgcgtgcacgagatcatttgccagggcagggaatttcaggtgcagcataaactcactaacaaaggaaataaaacatttgaagatattttagatcccgccgataatactgtcgcctctttaatccatgcattacccccaaaggatatcactttttatttacttatgacattttggcaattttctagtgacaacaaccatttttattataataccaagctgtttgctgcaaaagtccatcatcttttcgatgatccaacttcctttcaatcaaaagatggtggttttgtgtgtatgcttcttctgagcatggccatgggcagtctattctcctacattcgccatccagagttcctttctgatgaaaatcacgatcgttggacttatcctggctctcagttttaccaaaacgccaaacttctttttcccaaagtcatcagtgaatcgtcgttggaaacagtacagtctttcttcctagccggtatgtatttgtctccaacattggcacacgaagttgtatacatgtactttggtatagctatgagagctgctgttgccaatggtatgcacaaaaagtctgcgaatgctcaattttccggagatgttgctgaacttcgtaaacggcttttctggagtgtatattgcatggaaagaaaaataggtatttctctgggcaggcccgagagtcttgtgcgttccgaaattgatattcattttccagaataccgtgaaagtttagattcgcaaaacttcattgccagcttccggaccttcaccttagctattaaaatttcccttctaactaataaagtctatgacatgtggtattcctcgctacatggaaaggcgaacttaaaagcagctaccattaaagagattgtaaacgaaattgaggcatggcgccaacaactgtctcctgatctagaaatacaaaacattggcccagatagcaggtcttacagaggtatcgttcatttgcatctagcttatcatattgttcgaattgccatgggccgaccgttcttactacaccggcttcgtgaaagaacgatgaatagtaagacggatgagggagctaggcttcttactgataagttaatttcatactgctattcatccgctttgcacattgtcgacctccttgtactactaagaatgcacaaatttctatctgtctattcatttatggattaccattcatgtcatgccgcctcttttatcattctggtgcatcttctaatcaacccgtctgaacaaacgatcgaacaactgaatacggctattgacattttgaattttgttaccgacagatttccacttttaaaaggaagtacggatgtcataactaacttgcgggcatttgctgaacaaagcgaggtatatcaatcaaggcttaatgctaccgaaccagcttattcgacgcaggtgcctttcttccctagagatgctgattatcataatcaaatcaacctacaaaatctttggaatgatgaaaatatcaatgcctcactagaggcacttttcaatgatgcgaagggttttggctttttactccccgctgataacttcattttccctagtgacgatggagacatg

SEQ ID NO: 90 - protein, 767 aa, Schizosaccharomyces pombe
MHARMQPHEDRSRSGMSRSEAMELEDQLEEEERGGNVVVGSSSANANASTAETGKKSAGGSKPKRRRGERIPPSKRIRKAIAYVNKYASGCFGRVERRLVCTRSISRHSNQKLLDFCVECKKHKIKCVGNFPCGRCLKKGLECVIETPPRLLMNKDEISLNLQRLSHMETILSKLMPSMSLDLPSLEAKIAELSESLQTYPDKVLTDIELGSYQQVTLNETQTYYEDAGSNESFVARVHEIICQGREFQVQHKLTNKGNKTFEDILDPADNTVASLIHALPPKDITFYLLMTFWQFSSDNNHFYYNTKLFAAKVHHLFDDPTSFQSKDGGFVCMLLLSMAMGSLFSYIRHPEFLSDENHDRWTYPGSQFYQNAKLLFPKVISESSLETVQSFFLAGMYLSPTLAHEVVYMYFGIAMRAAVANGMHKKSANAQFSGDVAELRKRLFWSVYCMERKIGISLGRPESLVRSEIDIHFPEYRESLDSQNFIASFRTFTLAIKISLLTNKVYDMWYSSLHGKANLKAATIKEIVNEIEAWRQQLSPDLEIQNIGPDSRSYRGIVHLHLAYHIVRIAMGRPFLLHRLRERTMNSKTDEGARLLTDKLISYCYSSALHIVDLLVLLRMHKFLSVYSFMDYHSCHAASFIILVHLLINPSEQTIEQLNTAIDILNFVTDRFPLLKGSTDVITNLRAFAEQSEVYQSRLNATEPAYSTQVPFFPRDADYHNQINLQNLWNDENINASLEALFNDAKGFGFLLPADNFIFPSDDGDM

SEQ ID NO: 91 - DNA, 2208 bp, Schizosaccharomyces pombe
gagcctggaactccaaaaggttatgatggttcaaaaaactcatctcctgcttctgttccaagttggattcacgaaaagacaaaggctggaaaggatcgaaaacgtttacctttagcctgtcaatcttgtcgaaagaagaaagttaagtgttcgggagagcgtccttcgtgtgatcaatgcttaaaacataatattccttgtatatacaaatcaaattcaacaaagcgttctcactcacgccatgaagagattcatcatcagcaacagttacatctcaatcatcagtatcaacaccaacacaagaatgtcgctgcaaattcaatagataatctttctcggcaatattctcaaccaaatcacattaatacgcacgattctgttaacagccctccttcttatgggattatggcttctgctacaaaccagcctctttcccatccaactatagtaccttcttcaaattcttcgtctcttcttaattctacaaacaatatttctcataatcctcaggtttcgctgatgtcagcatctctctccaaaaatttggtcctagatcctgcttctccaaaatctgtctctcccgatctggtttatgtctcctccgataatccccccgtttccactgctgcttctgcttattctagttcgcttcctatttccgatgttactcgtgctttgcctttggcgcccgcctctaattcgcagcatccttctctttcctctcaaccagtttctgttccttctaatactattaatataccgacagactcgctttcaattgtttccaatccttctcaaactcccgcaaaatttgattcaaataggatttctcaagtgcccaactctgattactctatttattccaattttaataattttccaattgccaaccacgctccttcgtttccccaatcttctgtcaagaagcttgattcctcattttcgcctacatcccttcctacatttacaactaattccgcttcctcaggtctctcaacctcttatacaaacaataatgatacaacaagtgataataactcattacaagctgttcctcgtctggatcctgtgccgagtctgactttatcttccacgcccgtagctgagttgcctcccttggaacttcgaattcacctcgcagaggtattctttcactgttgccatggtcagtcttataatctgtttcatcgtccaactttttttgagtctttaaataataataccgtacctcttgtcgttgtttatgcagtgtgtgctgtatccgcccgtttctcatcgcgaatgcacgatagattctcccctccttatatggccggtgaacaatatgctcgtgaagcacgacgtttagcactcgacaattttgatagaccagatttatctttggtagctgctctcttactgctttccttgcatgactctggaacgtgtgaaactggcaaaagttggatgtatggtggaatggcacttcgtatggctgcggctttacaactgaactgcgaacaaggaagtaatcctttggaccttgataacattgattcaggacccagaatatcttttctggagcgtgaacttaggcgtcgtactttctggtcgtgcttccttatggatagatatgcttcctcccatgagcatttacaatttttggatgaaaatgatataggaattcaactacctgttcatgaacttctatttactaaacaaattgctggcgttacgcaaacccttgatggtcgaattttggaaggcgtcccaagtattgttattcccgcggatactaccgaaaatatgggagttgctgcctacactgtgaagattattgcattgtggggacgtgctgtaaaataccttaaacaagatggtaaaagacgcgatccatacccatattggcacagaaattctgatttttctcacattagtgaagccctctatgcctgggctgacgggttaccccaacggcttaaatattctgctgttggattggaaaaccatttatctatacaacaaggcgcccagtatgcatttttacatttggcatatcatcacactttaatgtggttattccgttctattggagaaaccgagaacaatcaactttccaaaatatctagttccgtatcgttagcaggaaacacagtctctttttctccagtgagtcacacacctattaatgtcactaatggtgaatctcaaaataatagcaataacgat

SEQ ID NO: 92 - protein, 736 aa, Schizosaccharomyces pombe
EPGTPKGYDGSKNSSPASVPSWIHEKTKAGKDRKRLPLACQSCRKKKVKCSGERPSCDQCLKHNIPCIYKSNSTKRSHSRHEEIHHQQQLHLNHQYQHQHKNVAANSIDNLSRQYSQPNHINTHDSVNSPPSYGIMASATNQPLSHPTIVPSSNSSSLLNSTNNISHNPQVSLMSASLSKNLVLDPASPKSVSPDLVYVSSDNPPVSTAASAYSSSLPISDVTRALPLAPASNSQHPSLSSQPVSVPSNTINIPTDSLSIVSNPSQTPAKFDSNRISQVPNSDYSIYSNFNNFPIANHAPSFPQSSVKKLDSSFSPTSLPTFTTNSASSGLSTSYTNNNDTTSDNNSLQAVPRLDPVPSLTLSSTPVAELPPLELRIHLAEVFFHCCHGQSYNLFHRPTFFESLNNNTVPLVVVYAVCAVSARFSSRMHDRFSPPYMAGEQYAREARRLALDNFDRPDLSLVAALLLLSLHDSGTCETGKSWMYGGMALRMAAALQLNCEQGSNPLDLDNIDSGPRISFLERELRRRTFWSCFLMDRYASSHEHLQFLDENDIGIQLPVHELLFTKQIAGVTQTLDGRILEGVPSIVIPADTTENMGVAAYTVKIIALWGRAVKYLKQDGKRRDPYPYWHRNSDFSHISEALYAWADGLPQRLKYSAVGLENHLSIQQGAQYAFLHLAYHHTLMWLFRSIGETENNQLSKISSSVSLAGNTVSFSPVSHTPINVTNGESQNNSNND

SEQ ID NO: 93 - DNA, 1809 bp, Schizosaccharomyces pombe
atgtctcaaaataaagcatgtgatctttgcaggttgaagaagattaaatgtagtcgagggcaaccaagatgtcagacttgtactctttttcaagcggactgtcattattctaatcgtgctcgccgtaagagacttgttcaaagaagcaaggagacgtttgggggaattacgttacccgttaaaaacattgaaaaacccgaggatggtgaagaatccgttcagagacgccttaaattgcttgaagaaaaaatcgatttgttgttagatatagctactgaaacttcagaatttaaacgtgaaaataaggctattgaattaccttccttggttacacaaattaaagatgcagaatcgattgttattaaacacagacaaggtagccctgtcgacaatacacctactcggatactgaatgtggaaagcttgttccctccacagttgccggactgggagaaggcattccatgacattcccaagaaggaagtagcccatgagttagtcacgtcttactttcagcatgtaaattggtggtggcctaccttcgtatataatgattttatgtatgagttcgaacgtctttatgcgttcgggttccatagcaataatgcttggctaatttctttttattctattttagcattaagcagcattaggaaaagacttggtaactcaaagacgcttgcagagtctttgttttcaacagcttgggtttttgttcaaaagtccgacttttttcttactccgagcattgacaaagttcaggctttaattgtcatgacacagtacgcagcttacctgtctagctcttctttatgtcggactttgtgcggccaagcctgcctcatggcccaacaattaaacttacatagaaagcaatccactgatgtggagcctgaaaaggctgaatcgtggaaaaggatattttggatgtgttatattctcgataaaaatatttctttgatttttggaaccccttccgtttttaacgacaaggatattgattgtaatttgcctgatagcaaatatgagcttttgtttggtgtacaatctggtggtgatttgatatttgttcctaccgtatcgttgacaataattcagagtgaaatacgaaatcgactatacagcgtgaagtcacctacgcaaatggcagcgagagaaaaaatcatcataccaatacatcaaaaattgaaagcgtgggaagaaaaccttccttctgaaataaaaatgtatcatgaaatgttgctaaacaacactttttctcccactatatcgcttagcgatcggttcgaatttttaactttcgcaggtatggaagtttacttttcttacttaaacactttaattatattacacagacctagctcgtcgacagagaatcgaaggatttgtattaatgcagcccgtgaagcagttcaattgttaaaaaatagactcaacattgatctcagggtcaatgttaaagcagatccgctatggatattcctatactgtccttttacaccttttttaataatatttaataaccttgttcacgaaactgatacggaaacggactcagaaacattacttaacgatttggatcttttacatgtaatttacgatttttttatggaaatggagccagttagtgacgtggctttggaacttgtcaaaattgcagacaaacttttgcgggttgctaaagaagtttgcagtgccaaaaataatgatgttacggattctacttttaaagatatcgttgaaggttttgaacttaacgacttaaacagttgggattttgacagagtaaccaatgttatgaggaatctt

SEQ ID NO: 94 - protein, 603 aa, Schizosaccharomyces pombe
MSQNKACDLCRLKKIKCSRGQPRCQTCTLFQADCHYSNRARRKRLVQRSKETFGGITLPVKNIEKPEDGEESVQRRLKLLEEKIDLLLDIATETSEFKRENKAIELPSLVTQIKDAESIVIKHRQGSPVDNTPTRILNVESLFPPQLPDWEKAFHDIPKKEVAHELVTSYFQHVNWWWPTFVYNDFMYEFERLYAFGFHSNNAWLISFYSILALSSIRKRLGNSKTLAESLFSTAWVFVQKSDFFLTPSIDKVQALIVMTQYAAYLSSSSLCRTLCGQACLMAQQLNLHRKQSTDVEPEKAESWKRIFWMCYILDKNISLIFGTPSVFNDKDIDCNLPDSKYELLFGVQSGGDLIFVPTVSLTIIQSEIRNRLYSVKSPTQMAAREKIIIPIHQKLKAWEENLPSEIKMYHEMLLNNTFSPTISLSDRFEFLTFAGMEVYFSYLNTLIILHRPSSSTENRRICINAAREAVQLLKNRLNIDLRVNVKADPLWIFLYCPFTPFLIIFNNLVHETDTETDSETLLNDLDLLHVIYDFFMEMEPVSDVALELVKIADKLLRVAKEVCSAKNNDVTDSTFKDIVEGFELNDLNSWDFDRVTNVMRNL

SEQ ID NO: 95 - DNA, 2349 bp, Schizosaccharomyces pombe
atgagccatgaattttcacctgaaaatacggcggttctgttcgaagccatgaagcaggagcagcataataggagacgtcgtgttcctatggagagacgaagaagggtggttctagcctgctttaactgcaaagcccggaaagttcgttgcgacggggcaaacccatgcaaagcttgtgcttccaataatttggaatgcacatatccagtaaaggatgaaaaagaaatggattattctaaggactactttattgatctttcaaaaagatacaagtgtttagaatatattgttgaacgtctttgttccaccaaagtttcgacttatactacaccttcattgattgaagtttgcaatcgtataagcaaccaaaaatcactattatcttcagatgtcttttccctcaatagtgaaagcaccaatagtcaacgtgacgtggatacccttacacaaggtgcacttgtttgttcacaaattcagcaagatccaacggtcgtagcagaggatacgaacaatggaatcaatgctgatgctagcgatcaaagcgttgacgaaatcatgaaattaattggaaaaataaaagttgactctaacggcgaatcccgttatataggagcttctgctggtgaagcattcgttgactctgttcaaagtgaactacttgtcgatccttctttttccgagctgagcgcgtattcccatacccatcacagttatcctccgaatgaacatgatgtaaatgctgttcaaaaagcgctgagtcttctccctcctcctgaagtttcagattttcttatcaaatctttctatggccatgttcaagcaaattttttctttttccatgaaacattacttcgttatcgtttaaaccttatcatgagcttccaaaatccatccgttgaccctggctttctttgcttgctaatgatgatctttgcacttggtagtatgtttgctcacatggaaattcgttctgctagcaatccttttgacaacccaggaaaacagttttttgatactgctaggcttttgttaccacaagtaattcagcaatgcaaaccaagcttggttcaggcttccatacttatggggttgtatcttcagtctacactttcccaaaagagttcctatacttacttcggactttctttatctgctgctgtcgcaaacgggttgcatcgtagctgtgaaaatccaaatattgatcccaagaccaaagaacttcgtaatcgcctatggtggtcggtttataccatggatcgcttaatcagtattgctacaggacgtccactttctattgcggacagcgaatgtgatgcggcattaccaacagtagtgcctgaattggaaatagaaggttctgcttccaacgttcataatatcatatctatgtctaaaattgcgaaaataatgggaaaaactatggaacaactttatggaactgtcaattataaaaagaatccaataaacataattgaatcccttcgcgccgatcttgaagaatggaagcgttctttaccaccatttcagattttggaaaatcttgatgctgaagacccactttttcgtgcaaatgtgcatttacacatgacatatgaccaagctattatcatcatgtctcgacctgttttactacataaaatgaaaaatgcaaaaaattctccgcgtgtcgatcgtatcaatgaagactgcattttagctgccaggcacttaatttcactcgtacatttacttcagaatcattctcaactctcttgttactctttctttgactataattataccttctcaagtgcgctggtggttttgcttcactgtgttaccgaaccttgtgaagaagatgacatagcaatgcagtatgcttactcagctctcgactatatggcagaagggaatgaagctgccaagaattgtgctagagttattcgactctttgatgctcatctcaaaggagctcgctctgacggtaatgggaatactagccaatctggtttcatggcgtggcagcgctggatcgcggaagtctctgctaaagacgaacctgaaaaacttatgagtccttacaataaaagtatcggtgggggaagaaatagtaattctttgactcccaatgcaaatttaggtgcagatgtttcgttctttccaactgatgatacatctttccttttggaccacagtaaactggatgatgatctagaaaagtttgctagcactttggatcctataaagacaacgcctgatcttgccaacgattcatctttgttaaactgggctaataccgatcaaggcatggatatcgaaggtagttggctaggtaatatgcatcctacttggctagattacgtttgtcca

SEQ ID NO: 96 - protein, 783 aa, Schizosaccharomyces pombe
MSHEFSPENTAVLFEAMKQEQHNRRRRVPMERRRRVVLACFNCKARKVRCDGANPCKACASNNLECTYPVKDEKEMDYSKDYFIDLSKRYKCLEYIVERLCSTKVSTYTTPSLIEVCNRISNQKSLLSSDVFSLNSESTNSQRDVDTLTQGALVCSQIQQDPTVVAEDTNNGINADASDQSVDEIMKLIGKIKVDSNGESRYIGASAGEAFVDSVQSELLVDPSFSELSAYSHTHHSYPPNEHDVNAVQKALSLLPPPEVSDFLIKSFYGHVQANFFFFHETLLRYRLNLIMSFQNPSVDPGFLCLLMMIFALGSMFAHMEIRSASNPFDNPGKQFFDTARLLLPQVIQQCKPSLVQASILMGLYLQSTLSQKSSYTYFGLSLSAAVANGLHRSCENPNIDPKTKELRNRLWWSVYTMDRLISIATGRPLSIADSECDAALPTVVPELEIEGSASNVHNIISMSKIAKIMGKTMEQLYGTVNYKKNPINIIESLRADLEEWKRSLPPFQILENLDAEDPLFRANVHLHMTYDQAIIIMSRPVLLHKMKNAKNSPRVDRINEDCILAARHLISLVHLLQNHSQLSCYSFFDYNYTFSSALVVLLHCVTEPCEEDDIAMQYAYSALDYMAEGNEAAKNCARVIRLFDAHLKGARSDGNGNTSQSGFMAWQRWIAEVSAKDEPEKLMSPYNKSIGGGRNSNSLTPNANLGADVSFFPTDDTSFLLDHSKLDDDLEKFASTLDPIKTTPDLANDSSLLNWANTDQGMDIEGSWLGNMHPTWLDYVCP

SEQ ID NO: 97 - DNA, 2067 bp, Sordaria macrospora
atgtcaacacggccccccaaccaccacggagacatcacgaacacatcctcagtcaacatgacgaccacaacaacaaccaagaccaaggcgaccgcaaaggccggcaccaatgccgcgcccaagcaaaagacacagatgcatcgccgctcaaggacaggatgttacacatgcaggctgaggaggaagaagtgcgacgagggttctcccatgtgcacagcttgcaagcatctcgggcttcaatgcgaatacaagaggccaatgtggtggagcaacaacgatttgcggaggaagcacaaggatgagatcaagatgatcatcaagaggaagaagctttcggagaagtcgtcgcataccatccagacctcaatcaacacaccgcccggcctctcgcactcgctcccgacgtcagcgaccttttcgggtccgcttgatcgcaacaggtccgcttcgatcgattcgcattttggcttcaacttcaacagccctcacaatggccaagatttcacaccatttgcgacgccacaaataaacatcaatggagagttcatcttcccacccttctctccctacgagatcgacatgaagaccgagcggcaaatattcatcaacgatgtcccgacccttcgtgaatcaacagtatcaaccttcagcacatatcagaccccgcctcctccgggtacaattctcccgtcattccctctggaaggtgaatggaccgagcaggtgttctcggagcggagagagtcgttgacggaggagacttttaatgccaacttcttcgactttgcttgcgatccggccttggcttcttcgcaagtggcagttgagttggatgagggtgaccagaagctcttcgatcactttgtgcaacacgttcttccgaccatcttccccattctggaatccaaccagcatggctcaatcagctctgagctcattctcccatcactggccaacaacaagggttacctgcactgctgcttgagcattgcggcgcaacacttcaagtctacaacgggcattcagagcgaggagatcgacaacgacatcatgcgccaccgctatgccaccatcacctggctgtgcgaggcactcaatcgcgatgagaaccaccagccaattctcgatgccacccttggcttgattttctttcagtgcatcgttggccgtcctgaggatactcttcctgatattccctggcaccaacatttccaagcggtggtatcgcttgtgcagaagctcgatcttgctggacttgtatcggatctcgccaagcctctcgcccacacccctttcaacatgacactcacgtcttggattgacatcttgggcgccaccatgctgggtagttcccccatgttcgcgcacacctaccgccacaagcatctttcggtcaacaaccactcgctcggcctgcgtgagttgatgggctgcgaagaccgcgtcatgtatctcatctcggagattgcctgcctcgagtcgctcaagaaccagggcatggacgacattaccctttgccagcacgtccgtggccttggcgacgagatcagcaataccgagatcaacgagggcacgctcgtcgagccttacaacgccaacggcaccctgagccctaaacaactgagcaagaacatcaccgccgccttccgtcttgctgctcgcatctacctctgcagcctggtcccgggcttccaccctgcccagcccagctgcatgggtctcgtcgagaagctcaccgcggtcctccagctgatcccctcgggggtcaacgggtatgaccgctcactcacctgggtctacctgatcggtggatccgtcagcgtggacggctcctccttcgcgactttttcgagacccgcatcgcccagctcggcgaacgcggccagctcgggcagctttggacgcacgaccgtcctccttcgcgagacctgggtgcaatatgcggccgccgtggcggcgtacgaggcgtctaaggcggcagcgggaaattcatctcctcagccacaagagccttacgtcaggtggcgggatgtcatgcagaccgagggatgggactacttgctcatc

SEQ ID NO: 98 - protein, 689 aa, Sordaria macrospora
MSTRPPNHHGDITNTSSVNMTTTTTTKTKATAKAGTNAAPKQKTQMHRRSRTGCYTCRLRRKKCDEGSPMCTACKHLGLQCEYKRPMWWSNNDLRRKHKDEIKMIIKRKKLSEKSSHTIQTSINTPPGLSHSLPTSATFSGPLDRNRSASIDSHFGFNFNSPHNGQDFTPFATPQININGEFIFPPFSPYEIDMKTERQIFINDVPTLRESTVSTFSTYQTPPPPGTILPSFPLEGEWTEQVFSERRESLTEETFNANFFDFACDPALASSQVAVELDEGDQKLFDHFVQHVLPTIFPILESNQHGSISSELILPSLANNKGYLHCCLSIAAQHFKSTTGIQSEEIDNDIMRHRYATITWLCEALNRDENHQPILDATLGLIFFQCIVGRPEDTLPDIPWHQHFQAVVSLVQKLDLAGLVSDLAKPLAHTPFNMTLTSWIDILGATMLGSSPMFAHTYRHKHLSVNNHSLGLRELMGCEDRVMYLISEIACLESLKNQGMDDITLCQHVRGLGDEISNTEINEGTLVEPYNANGTLSPKQLSKNITAAFRLAARIYLCSLVPGFHPAQPSCMGLVEKLTAVLQLIPSGVNGYDRSLTWVYLIGGSVSVDGSSFATFSRPASPSSANAASSGSFGRTTVLLRETWVQYAAAVAAYEASKAAAGNSSPQPQEPYVRWRDVMQTEGWDYLLI

SEQ ID NO: 99 - DNA, 1875 bp, Schizosaccharomyces pombe
atgagtgaaacaaccaagtctggttctaaaaaatcagggcagacatcacgtagggcgatccattcgtgtttggcttgtcgaagaaaaaaacttaaatgtgatcatggaagaccttgttccaattgcttaaagcgatcaacaatccagtcatgtatttatatagatcctgggaaaactaattatgacaagcgctttgaacggggtagcgaagctgacgaattgatagatcagttactatcccgagttagcatgctggaaaaacgtttaaatgaggtcggcactaaatcgcaatctgattatgaaaaccaacaatctcataatcttccttccacgccttcggcagatgctgagacacagcgaaacattggttctctttcagtattagatgatacaaaatcacaatatgctaactactcgtcctcttcacacgtactctggcatttaaggaattatcattatcttaacttagatcaagatattcaagaagaaaacgattctctgattagtccgtttttttttcgaatatcccccaatgaatctgcatacgactatttaccccccaaaaaagtatcggatattttaattgagcagttcttttttcggtgtcatatgctcattaatgttttacacagaccaactttttatgtacgatataatgatttttgggaaaaaccgcacttgcgaaaaccagcttttactagtttattatacgcaatctatgctagtgcattactagctacacctgttgaagtgcaaaagacatgggcgcttggtgaagacgagagatatcttcaggtagattatcatcaagcttttcgctacgcactggcttcgtctaattttctgtttgaaccagatcttaatgctttgcaagctcttgttctttgtcaggttgtctttgattctgaccgcattcgcgctccaccttccttagtcggcttgattcttcacgtagcgctatgcatgggccttcacagagatggctcgctttatggacttaatccggtaatttccgagattagacgtcgtgtgtgggcgaatatagtcttgtcggatcttagaacttctgaaactattggttatcctcctcaaattgttgagggaaattatgatacacgtcttccctctgctttacctgatgaaattcataatgtagattcttccgttattatttctgaggccacttttgttaacattatcacgaaggtttcacgagcatattcaaagtgtttgaaagttttgctaggcattatagctcctaattatacacgtttattagagcttgacagggagctttccaatttttttaaagaattgatagaagtgaatattccaactagtaatactatgcacgaacggcatattcgacttttagtttcctatttgtcaaacagattcccaattctcttgcattttccgttccttttaaaaaaaaattctgcacaattcgcctacagtcattcgcgtgctttggagtccgcgactctggctttaaaccagctgtacgaactaggcagcaatccagaatactcaaagtattcatggtatctttggagatatccgccgtttcatccctgcatcgtgcttttgctcgatttactaaattctcaaaaaatcatttatttggatgatgaacgagttgttcttttaaacaaaatattttctctttttcctcgcagttctggtaaagagcattatcaaaaagcctgggcacttttacaaacttcaagggcaaaagtttgggaaaagcttgggttgagcactgtcgacgtatcgaccactgatgtgaggcttacaaattttgaattttttgatgctaacaatcttgatatcaattgggatgattgggatgctatatttcaacattgtccattc

SEQ ID NO: 100 - protein, 625 aa, Schizosaccharomyces pombe
MSETTKSGSKKSGQTSRRAIHSCLACRRKKLKCDHGRPCSNCLKRSTIQSCIYIDPGKTNYDKRFERGSEADELIDQLLSRVSMLEKRLNEVGTKSQSDYENQQSHNLPSTPSADAETQRNIGSLSVLDDTKSQYANYSSSSHVLWHLRNYHYLNLDQDIQEENDSLISPFFFRISPNESAYDYLPPKKVSDILIEQFFFRCHMLINVLHRPTFYVRYNDFWEKPHLRKPAFTSLLYAIYASALLATPVEVQKTWALGEDERYLQVDYHQAFRYALASSNFLFEPDLNALQALVLCQVVFDSDRIRAPPSLVGLILHVALCMGLHRDGSLYGLNPVISEIRRRVWANIVLSDLRTSETIGYPPQIVEGNYDTRLPSALPDEIHNVDSSVIISEATFVNIITKVSRAYSKCLKVLLGIIAPNYTRLLELDRELSNFFKELIEVNIPTSNTMHERHIRLLVSYLSNRFPILLHFPFLLKKNSAQFAYSHSRALESATLALNQLYELGSNPEYSKYSWYLWRYPPFHPCIVLLLDLLNSQKIIYLDDERVVLLNKIFSLFPRSSGKEHYQKAWALLQTSRAKVWEKLGLSTVDVSTTDVRLTNFEFFDANNLDINWDDWDAIFQHCPF

SEQ ID NO: 101 - DNA, 1962 bp, Schizosaccharomyces pombe
atgtctaatttgattttaacgccttcaaacaatggcacagaacggccttatcgctcaaggaaaactagaccttgtgacaattgtcgattgcggaaaagcaggtgtgtggtagagtcaattggaaatccctgcttattatgcacgcagttgaaaattccatgcacctaccatcttcctcctataaagcgcaacaaacaaaaaaagcaacaggattctgtttcagatgacacaccatcagaagcaacaacaacgactaacgacgatcgtgatccaaagtacaatgccttaggcaataatttggatgctgtaagaggaaaagtgatttcacctacgcaagggtcagatgctcgtggacctgatggtcgtcaagttccattaaatctagcaggcattactgaaatgtatcatacttcagatgataaatttgacaaacttggacttgacgattctttgaactatccttatgtgttggggccaacctgtgattcagacatcgatcttattcgtgagtatttttcgtttgaaaacggtgtttgctctttcgataatatgactgttaagtacgtttctactagctccaaatcacctgtaatgtatatcctggatcctgcgtatgagaatgaccgtcatagtgatttttctcgatatgatcatgctttgcacgatctattatcaacatacattgatgaggcaactggccgcactttagttaatttgtactttagtcatgtgcatccttcttatcctattcttcatggacctaggtttttattatcatataaaaacggttctcgaaatgtaccgtctattttacttgccgcactttattccgtagctcttacctactggccttctgattctcgatcgtttggagcgccaccactagatcaacggaaaatgtggaccattgtcgaggaagggttgaattttcattttacacaaccacgacttagcacgatacaagctgctctcttgtatttaattagtcgtcctttacataatatgtacagtctttccagtatcctttcccgtacgactgtcctttcgcagttgttgggttttaatcatgattgcacggaatggaagatacccaatgaagagaaaaccatccgtaaacgcatttggtgggctatttttattgctgataaatggtattcaatgtattttgggttagctacgaacattcatgaagatgattttgtcgtcccaaaaatagaatctgatgaatcattgcctctggaaatcacatcgtcacattcctttaaaacatttcttaaaatgatagagcttagttctcttttacaggatatattacaagacttatttactgtccgtgcattaacccgtcattcaaaaaacaatcgttctattagttaccagatcattggcttttttaccagattaaacagtatccgtcctgtagaatttacagagcctgcgctcggagttgcctcattaaaaatccagtttgatgctgttgaaatattgttgtggaagacggcattgaggttcaacttacccgattttcagtctgcagatgacttattcgtttgcgtagaaaaatctgtttcgaattttgtacaaatcacagccaactcttcgggagactttttctggccttacgcaggattccatttttcaacacttgtttcgcttttaattcgcttgcatttagatttccatacaaacaatacatacggagctagagctttctcacttttggatgcgtttgtgcggcactgtatcacgttgcatgaggcaggttttgactttgttgaaatggcaattaggcgatcgtcttctttgttaaaggagctgggcaaggaccatccgcatttattggctcttcgagacgatatatttaattctaatgattcgcgaggcgaagaagcttataatcacgtaccagagcagctgtttgatccatggaatcctcattcatggacgtttcccaagtccgat

SEQ ID NO: 102 - protein, 654 aa, Schizosaccharomyces pombe
MSNLILTPSNNGTERPYRSRKTRPCDNCRLRKSRCVVESIGNPCLLCTQLKIPCTYHLPPIKRNKQKKQQDSVSDDTPSEATTTTNDDRDPKYNALGNNLDAVRGKVISPTQGSDARGPDGRQVPLNLAGITEMYHTSDDKFDKLGLDDSLNYPYVLGPTCDSDIDLIREYFSFENGVCSFDNMTVKYVSTSSKSPVMYILDPAYENDRHSDFSRYDHALHDLLSTYIDEATGRTLVNLYFSHVHPSYPILHGPRFLLSYKNGSRNVPSILLAALYSVALTYWPSDSRSFGAPPLDQRKMWTIVEEGLNFHFTQPRLSTIQAALLYLISRPLHNMYSLSSILSRTTVLSQLLGFNHDCTEWKIPNEEKTIRKRIWWAIFIADKWYSMYFGLATNIHEDDFVVPKIESDESLPLEITSSHSFKTFLKMIELSSLLQDILQDLFTVRALTRHSKNNRSISYQIIGFFTRLNSIRPVEFTEPALGVASLKIQFDAVEILLWKTALRFNLPDFQSADDLFVCVEKSVSNFVQITANSSGDFFWPYAGFHFSTLVSLLIRLHLDFHTNNTYGARAFSLLDAFVRHCITLHEAGFDFVEMAIRRSSSLLKELGKDHPHLLALRDDIFNSNDSRGEEAYNHVPEQLFDPWNPHSWTFPKSD

SEQ ID NO: 103 - DNA, 2715 bp, Tolypocladium inflatum
atgacggagccaactaagcgagcccgcggcgactcccatcccgtcacgcagcctgtgaaacccgagacgatgaggtcgtcttcggctccatcggcgccgcagggtgccgcagctcccgatgctaccaccaccacacctggcgccaagaagaagacgcgccgaggagccgaatcgtcaagccagaagagacggtgcatcagtacggcctgtgtcgcgtgtcggaagcgcaaatccaagtgcgatggtgccctgcccagctgtgccgcctgcgccagcgtgtacggcaccgagtgtatatacgaccccaactcggatcatcgccgcaagggcgtctaccgcgaaaaggtagacagcatgaaggcccgcagctctaccctgcagatcctcgtcgaggccatcctcaacgcccccgaggatgatgtgccgaccatcgtcaggaggatccgcgcctgtgacagcctcgacagcgtggcagagcagatcgtcaactcggcgcccgacagcagtgacgccacccctgaccagatggatgaggacgacgccacgggccttgtgcccatcgaaggggagaatgaactggcccggaagatgggcgagctcaggctcgagaatggctctgttcgcttcatcggcggcacctcgcacctcatctaccatggcgacccgaccgacgagctggacgtcgaaagtcagcttgatcagtaccccccgagcgacaaccccgttacctcctggacccgcgtcaccaccgacgtcggtctcgtgacccatctcatcaacatgtacttcagctaccactatgcctacttcacgaccctgtccaagaagctcttctggcgcgatttcctgagaggcaggacgcgtctggagcgcggtaccacagctcactgctcacccttgttggtgaatgccatgctggcactgggctgccacttcacggacgtccctggtgcgtacgatgtccctggagatagtaggaccaaaggtgaccacttctttgccgaggcaaagcgtctgattcttgccaacgatgagtttgcaaggccgcgtctcgtcaccgtccaggctttggcgctcatgtcagtccgggaagctggctgcgctcgcgaggccaagggctgggtgtacagcggcatgagcttccgcatggcccaggacatcggtcttaacctcgagatcagcggaacggcaaggcaacgcctgactgacgaggagattgatgcgagaaaagtcaccttctggggatgctttctcttcgacaagtgctggtccaactacctgggcagattacctcaactacccaagagctcttccaacgtctcgaggttcgatgtattccccgatgaagacgccgcgatgtggtctcctttgaccgataagggctacgatgaatcctacgagcaaccatggagaacgcgagcggcagctttgcagctctcaagtctgtcggaaatcagcagcgatcttctcctcttcttctatcacccaaatcacattggcacgttccgcgggaagtcggccgaactgaagaagcttagcgagattcatcaacggctggaggagtggcgcaaggagttacccaacgagtttgagcccaaagaaggacagttgcccaatgtgattcttatgcacatgttcttccatctccaatacattcacctcttcaggcccttcttgaaatacgctccgtccggttcgccgctgccggcccacgtctccccacggcggatatgctcggccaatgccggagccatctccaagctcatgcgactctacaagaagacgtataacctgcggcaaatatgcaacattgctgtgtacatgatccacagcgcctgcacaatccacctgctgaacttgcctgagaagagtgccaggcgtgatatcatccatggagtcaaacacctggaagaaattgccgaagattggctctgtgcccgacgaactctgagtatcctcagtgtccttgccaggaaatggagatgcgagctccccgaggatgccgcctctgtcctccaacgaacagacgagaagtacgggttcttcagcacctctgacatcccttcccctgcatcaaccccacatacctccccgatggtatcagacgacggctcggtttccacgtcgcaaagagagtacagccctctgagccactacgcccaagctcacctgaatcacctcacgctacctgccggatctattgacgatcggatgtcgatgccgccgccactacaggcgatctgtggcgatcctctccttccccaacagcaacaaacagcaacaacacaccagcaaggtataccattcgacacagggcgattagaattcaaccctgatatgctagagggatgggcgcgtcaaggtgctagtgcaccgacatcaggcttcgactcggcattccttccagccaacggcaatggcatggcaccgtccgatgacaacagccaaactagcactaggcaggcgtcacacagagtccatgaggccagcatcaacggccagcactggatcctgaacgacagtgcgagatggcatcaaaacttcgaagggtggggtattggcggaaacctcccagccgactctgtcttcatgtttggccacaaccggaacaacaacatttcccaagctccatcggataccagtgagcaggcgcaaacttgtttcgagggcctcgctgcgtcgttgagtgggggaggctggctaccgggcttggat

SEQ ID NO: 104 - protein, 905 aa, Tolypocladium inflatum
MTEPTKRARGDSHPVTQPVKPETMRSSSAPSAPQGAAAPDATTTTPGAKKKTRRGAESSSQKRRCISTACVACRKRKSKCDGALPSCAACASVYGTECIYDPNSDHRRKGVYREKVDSMKARSSTLQILVEAILNAPEDDVPTIVRRIRACDSLDSVAEQIVNSAPDSSDATPDQMDEDDATGLVPIEGENELARKMGELRLENGSVRFIGGTSHLIYHGDPTDELDVESQLDQYPPSDNPVTSWTRVTTDVGLVTHLINMYFSYHYAYFTTLSKKLFWRDFLRGRTRLERGTTAHCSPLLVNAMLALGCHFTDVPGAYDVPGDSRTKGDHFFAEAKRLILANDEFARPRLVTVQALALMSVREAGCAREAKGWVYSGMSFRMAQDIGLNLEISGTARQRLTDEEIDARKVTFWGCFLFDKCWSNYLGRLPQLPKSSSNVSRFDVFPDEDAAMWSPLTDKGYDESYEQPWRTRAAALQLSSLSEISSDLLLFFYHPNHIGTFRGKSAELKKLSEIHQRLEEWRKELPNEFEPKEGQLPNVILMHMFFHLQYIHLFRPFLKYAPSGSPLPAHVSPRRICSANAGAISKLMRLYKKTYNLRQICNIAVYMIHSACTIHLLNLPEKSARRDIIHGVKHLEEIAEDWLCARRTLSILSVLARKWRCELPEDAASVLQRTDEKYGFFSTSDIPSPASTPHTSPMVSDDGSVSTSQREYSPLSHYAQAHLNHLTLPAGSIDDRMSMPPPLQAICGDPLLPQQQQTATTHQQGIPFDTGRLEFNPDMLEGWARQGASAPTSGFDSAFLPANGNGMAPSDDNSQTSTRQASHRVHEASINGQHWILNDSARWHQNFEGWGIGGNLPADSVFMFGHNRNNNISQAPSDTSEQAQTCFEGLAASLSGGGWLPGLD

SEQ ID NO: 105 - DNA, 2508 bp, Saccharomyces cerevisiae
atgctagacaaggcgcgctctcaaagcaaacacatggacgaatctaatgcggctgcctctctgctttcgatggaaacaaccgccaacaatcatcactatttgcacaataaaacatctcgtgccacgctgatgaatagcagccaagacggcaaaaaacatgcagaagatgaagttagtgatggagctaactcccgccatcctacaatttccagtgctagcatcgaatctctcaagacaacctacgatgaaaaccctttgctttctattatgaaatcgacatgtgcgcccaacaacactcccgtgcatactccgtctggttcgccgagtttgaaagtccaaagtggcggagatatcaaagacgatcctaaggaaaacgatactactactacgaccaatactacacttcaagatcgccgtgacagcgataacgctgtgcatgctgccgccagcccactcgcgccttccaatacaccttcggatcctaagtcattgtgcaatggccatgtcgcacaggctacagacccgcaaatttccggtgctattcagccgcagtatactgcaaccaacgaggatgttttcccttactcctccacctccactaatagtaacactgccactactactatcgtcgccggcgccaaaaaaaaaatacatttgccgccaccacaagctccagcggtttcttcccccggtaccaccgcagcaggctcgggcgcgggcacgggctcgggcatccgttcccgcacaggatcggatttgccgctcatcattaccagcgccaacaagaacaacggtaagactaccaattcgcctatgtcgatactgagcagaaacaacagtaccaacaacaacgacaataattcgatacaaagctcagattcgagagaatcctctaataacaatgagattggcgggtatttgcgcggcggaactaagcgcggcggcagtccatctaacgactctcaggtccagcataatgtgcatgatgaccaatgtgccgtgggcgtggcgcccaggaacttctatttcaacaaggatagagagataacagacccaaatgtaaaactggacgagaacgaatcaaaagtcaacatatccttctggctaaattcgaaatacagagatgaggcttattctttgaatgaatcatcctccaacaatgctagttcaaacacggatacgcctacaaactctcgacatgcgaacaccagctcttccattaccagcagaaacaatttccagcattttaggttcaaccaaataccttctcaacctccaacttccgcatcttcgtttacaagcacaaacaacaacaaccctcaacggaccaatatcaatcgcggtgaagacccgtttgccacttcgtcaagaccttccactgggtttttttacgacgatttgccgaatcgtaacaatagaaatagtcccttccatacaaatgaacaatacatcccaccacctccaccgaaatacatcaattctaaattggatggattgagatcaagattattgctcggtccgaattctgcgtcttcatctaccaaactagacgacgacttgggtacagcagcagcagtgctatcaaacatgagatcatccccatatagaactcatgataaacccatttccaatgtcaatgacatgaataacacaaatgcgctcggtgtgccggctagtaggcctcattcgtcatcttttccatcaaagggtgtcttaagaccaattctgttacgtatccataattccgaacaacaacccattttcgaaagcaacaattctacagctgtttttgatgaagaccaggaccaaaatcaagacttgtctccttaccatttaaatctaaactctaaaaaggttttagatcccacttttgagtcaaggacaaggcaagttacttggaataagaatggtaagcgaatagacagacgcctttctgctccagaacaacagcagcaactggaagttccaccattgaagaaatcgagaaggtcagttgggaacgcaagagtagcaagccaaaccaatagcgattacaattctcttggcgaatcctcaacttcgtcagctccatcgtctccatctttgaaggcttcttctggcttggcatataccgctgattatcccaacgctacttcgccggatttcgctaaatctaaaggaaaaaatgtcaagcctaaggcaaaatcaaaggcgaaacagtcatcaaagaaaagaccaaataatactacttcaaaatcaaaagcaaacaattctcaagaatcgaataatgctacttcctcaacgtctcaaggtacaaggtcccgtactggttgctggatttgtagattaaggaaaaagaagtgtaccgaggaaagaccgcactgtttcaactgtgaaaggttgaaattggactgtcactatgacgcgttcaaaccagattttgtatctgatccaaagaaaaaacagatgaaactggaggaaatcaaaaaaaaaacaaaagaggccaaaagaagagcaatgaaaaaaaaa

SEQ ID NO: 106 - protein, 836 aa, Saccharomyces cerevisiae
MLDKARSQSKHMDESNAAASLLSMETTANNHHYLHNKTSRATLMNSSQDGKKHAEDEVSDGANSRHPTISSASIESLKTTYDENPLLSIMKSTCAPNNTPVHTPSGSPSLKVQSGGDIKDDPKENDTTTTTNTTLQDRRDSDNAVHAAASPLAPSNTPSDPKSLCNGHVAQATDPQISGAIQPQYTATNEDVFPYSSTSTNSNTATTTIVAGAKKKIHLPPPQAPAVSSPGTTAAGSGAGTGSGIRSRTGSDLPLIITSANKNNGKTTNSPMSILSRNNSTNNNDNNSIQSSDSRESSNNNEIGGYLRGGTKRGGSPSNDSQVQHNVHDDQCAVGVAPRNFYFNKDREITDPNVKLDENESKVNISFWLNSKYRDEAYSLNESSSNNASSNTDTPTNSRHANTSSSITSRNNFQHFRFNQIPSQPPTSASSFTSTNNNNPQRTNINRGEDPFATSSRPSTGFFYDDLPNRNNRNSPFHTNEQYIPPPPPKYINSKLDGLRSRLLLGPNSASSSTKLDDDLGTAAAVLSNMRSSPYRTHDKPISNVNDMNNTNALGVPASRPHSSSFPSKGVLRPILLRIHNSEQQPIFESNNSTAVFDEDQDQNQDLSPYHLNLNSKKVLDPTFESRTRQVTWNKNGKRIDRRLSAPEQQQQLEVPPLKKSRRSVGNARVASQTNSDYNSLGESSTSSAPSSPSLKASSGLAYTADYPNATSPDFAKSKGKNVKPKAKSKAKQSSKKRPNNTTSKSKANNSQESNNATSSTSQGTRSRTGCWICRLRKKKCTEERPHCFNCERLKLDCHYDAFKPDFVSDPKKKQMKLEEIKKKTKEAKRRAMKKK

SEQ ID NO: 107 - DNA, 3168 bp, Candida albicans
atgtcgataaagttagaacaacagcagtcaagtgtatcacaggagaacaatttaccacctacaaagaagaagaccaaggctttgaagtcatctgatggtactgtaaatacaaggaccattaaagtaccaggatcgaaagttgaaagagtggcacaagcatgtgacagatgccgagctaagaaaacaaagtgtgatggacagaacccatgttcaacatgccagtcagtaggattagagtgtattgtttcagatcgtcttaccagaaaatcctatcccaaagcatataccgagactcttgaagaaagagtacgacagctagaggctgaaaacaagaaattagctggattattagatatgagagatgaacaactcgaactacttaatggatctggattaactgaagatacaagtgaaatgtctgagaacaaagaagatgactttaagaaagtaacagcttcaaacttgagtcttttggatatccaaaatagtttgcacctgcatctgccaaacgagaacggcgaaaactgcccatgtgggtgctccaatccacatgccgtccacgaacgaccagtttcgatagcagggtccatttacggtgctgttgctgccaatgaaagagttccaatatctatagctggatcgataaaattaagtgatgaagaagatgaagaagataatgcaagtttattgagtattgaagactataattctagacaccgagaccagcattttcattttgcttcaaactcaacaaatagagaacaaagtccagcaccaggggcgtttgccgcagctactgctattgctcaaatgcagaagaacaaacttttcctacaacaacagcaacaattagaaaacgaaaacaacaaacaacaaatgctcacatcattagtggccatgtcgataccaagaagtacagaagaaacattatgtgtacctacattacttgcaagaatttgtcaaacttatggatacgattctaagcaggcgattttagcagccaactctttagcatctttgaaagaaaatattacctctaatacaggaacactgttggatgaagaacgtaaaaatgctttgaacagtatgataatgaacagatatgaaacaacaaaattgtcagaggaagaggctattgtttttacaaaggatttgattaatttaccggcatccagattagacatggatcagttgattactgtgtatttccaagaatggggcaatgctctaccgatattggataagaatgcatttttgaaaaactatatgaaattgaattacatattggagcagggccattacaaggaatataaaggagagtcatcctatgagctgattgagaaatttggggccatactcatacttgttctatgtttggctttccacattagcaagaagaattatttagagtcgtttaaccctcagatccaactgagatttgtcacattgcttcagcattacgattatttgatccatgaatttattaaaccaaactgtttgataactcagtactgttctattcagtctttgcaaatcttatcgttggcattacaatactgcttagtgactggtgatacagccagttgttacgaactcagaggaagggtgatcagtatggctcaacaattgagattgcataggtgtccagctgcagtacttggattgagtggcaataaggagggagacattgatcttcaaaatttcatgcaaggggaaagacgtatcttattctggtgtatctattgtctcgatgtatattcttcactcaatttggggatccccagattgttcaaagattatgaaatagagtgtgcgatgccattttgcggtaaaagtgacgactacgacgacgtgaaccaggaggataatgtcaatatcttgattgttaacaataccaagttatctattgtagggaaagtgtcgaaaatggctctaagtgtgatgctgtacagtaaagtgttggcaaatattttggattctatatattcacgattcgataatactaacattcataagaaagcgttacaaagagataggatgctagattgttggagacgagaattacccctagacttaaaatttgaaatcgatattaatgggttgtctctcaaagattccagtaacaattttatagagggtaacatttggagaaactacaacaagcaacagttgacgttaatatttttgtattaccatgctaaaatattgatatatttgccaatattatcccggtttggaaatcaccataatgttgggttatcacagaaagagcagctcctgaaaggagaaggtgatgtggctactatagtgtcaagcattagtttgattcaacaatcatcgattcagatattagaggttttgaaatatttgacatcaacctcgtcgtcaaacattttacctataccaattcatattgtgcgtgagcagtcattattggcgttaatggtagcaaaaggagccttagattatataaaaggaggtcctttattcagcaatctgaagcaattattactagatacaatgggtaacctttctcgtgatgccaactttgacatccctggggctttgaatagaaaatcattcaaattgtttgagattacaatattaggtatccttggtttgaatataaacaaaagcatgacctcgggggttaatatgaaaagaaagggatcaagtgcactacaacctatcaccaaaactgcggttgaaagatcaccaactgttaatttaactaacaatttcgcagcttcgaaattgaaaacgccaactagcaatacagatatggtaaacaataatcaaatacttaaaatagagcaacaagatccagttttatcgcagcaacaaaaacaaacaaggaatatatctactagggaaatctctaataatggggatattgagttggacaattcgaataattacgccgatgacatagaatcattagaggaattattaaattttgatccatttaaagtcaatgttaaccgtcaaatgttagtgaacgagtttgtcactgatggatctttaggtttagttccatttttggaaatgaacaatgaacaattaaatgacagttctatgttatttgacaagtcgtacaatgctataaacgaacgcaagaccacaaaccatgatgattacatatcacataatgatagtcatttctggaaa

SEQ ID NO: 108 - protein, 1056 aa, Candida albicans
MSIKLEQQQSSVSQENNLPPTKKKTKALKSSDGTVNTRTIKVPGSKVERVAQACDRCRAKKTKCDGQNPCSTCQSVGLECIVSDRLTRKSYPKAYTETLEERVRQLEAENKKLAGLLDMRDEQLELLNGSGLTEDTSEMSENKEDDFKKVTASNLSLLDIQNSLHSHSPNENGENCPCGCSNPHAVHERPVSIAGSIYGAVAANERVPISIAGSIKLSDEEDEEDNASLLSIEDYNSRHRDQHFHFASNSTNREQSPAPGAFAAATAIAQMQKNKLFLQQQQQLENENNKQQMLTSLVAMSIPRSTEETLCVPTLLARICQTYGYDSKQAILAANSLASLKENITSNTGTSLDEERKNALNSMIMNRYETTKLSEEEAIVFTKDLINLPASRLDMDQLITVYFQEWGNALPILDKNAFLKNYMKLNYILEQGHYKEYKGESSYESIEKFGAILILVLCLAFHISKKNYLESFNPQIQSRFVTLLQHYDYLIHEFIKPNCLITQYCSIQSLQILSLALQYCLVTGDTASCYELRGRVISMAQQLRLHRCPAAVLGLSGNKEGDIDLQNFMQGERRILFWCIYCLDVYSSLNLGIPRLFKDYEIECAMPFCGKSDDYDDVNQEDNVNILIVNNTKLSIVGKVSKMALSVMSYSKVLANILDSIYSRFDNTNIHKKALQRDRMLDCWRRELPLDLKFEIDINGLSLKDSSNNFIEGNIWRNYNKQQLTLIFLYYHAKILIYLPILSRFGNHHNVGLSQKEQLSKGEGDVATIVSSISLIQQSSIQILEVLKYLTSTSSSNILPIPIHIVREQSLLALMVAKGALDYIKGGPLFSNSKQLLLDTMGNLSRDANFDIPGALNRKSFKLFEITILGILGLNINKSMTSGVNMKRKGSSALQPITKTAVERSPTVNLTNNFAASKLKTPTSNTDMVNNNQILKIEQQDPVLSQQQKQTRNISTREISNNGDIELDNSNNYADDIESLEELLNFDPFKVNVNRQMLVNEFVTDGSLGLVPFLEMNNEQLNDSSMLFDKSYNAINERKTTNHDDYISHNDSHFWK

SEQ ID NO: 109 - DNA, 4335 bp, Kluyveromyces lactis
atggtcgagaagaaagattcagctggccggtttaatggacaaccgagccatggcgggccgaggtttattaggacgctgggctcgcagtcattaagtggtctgaatcctttatccaatgcgcagcaaggggtttctcagcaacaacaacacctaagccatcattctcataacgttacagactcagactctcccagtattcaagattccgggattcctatcacatccgctttgatcaagaaggagtcacctagtcatgcggtttctggtataccgtctaactcaaacagtattaataacaatagtaaaagcaattccaataataatccatccagtgtttttagcagcagaaataatacatcgatacaacaattgcagcagggcccatcacctacactgtcgaattcagagtcgcccgtaaacgcgtcccttttatcgtctatcactacaccgttgttgcatcaaactggttcggcaagccatccgccatctaatacggggtccagtaccaatgggacaacaactccttcgtatcgtgtggctcaagcgtgtgacagatgtagagccaagaaaattagatgtgatggtaagaggccgcagtgtacacagtgtgctgcggttggttttgaatgtaaaattagtgataagctaagccgtagagctttcccaagaggatacacagaaacgttggaagaacgagtaagggaacttgaagctgaaaatagaaggttggtagctctctgcgatttgaaagaagagcaattgcatttggtatcgaaatatagtaacagcaaggacgaaaacggagtagagattccatccaccgaagaagaacaaattttgcatgaactctctaagaccaatggcggttccctaagagtcagttccacgaacttatacttacttaataagaaagcttcgcctggtgatgatagtcatattgagtcatcagagccatctataccagttcgcaaagtggcaatcactgcgccttcaccacgcatcatgtcgccaagaaacagtgttgcggattctgatccatcccaaactaataccggtaataacgaccatattcattccaataataataaccacaatcaaaacaatagtactgatccttacggaatttctttcgaacaaaatgaagcgccaggtcttcccgcgctaaaagctctctcatctttgtcgaagtataagcaaggaactcagttggccacattggtcgccgtttcagtgcctagaacaactgaagaaattctcttcgttcctcaacttttggcacgtatcggtcaaattcatggttttacttcaaaacaatgcatatataccgcatccgtcctagcatccttaaaagaaaacaacatctcttcaattccaccagagttagaagtgttgaaaaatcataacctatgggaaattgacgatgtcttgcatttctggaagaacgtgttcaagttggattttatgacacatactgccgtggaccattcctctactcatttaaattttgccgaagtcgaagaattgatgcaactcttttttcaggactggtacgagctaattcctttgttcgataaaaatgaattcaactcatactatgaaaagttcaagctgaacgtaactgaccccaatttctttgtcagaaaagatgacactgttttcaacaaccgcactagatctatttcctataaaatcttctcctgtttgttgattataatagttcaaatgggcatgttatctaagatcaaaagagacaagataacatctggtaaattgagtacattaatgaagtactatgataagctaatgactcatatttggatcaatccgtacttcaattcgagaaatacttccattcaggttttacaatgtctttcgatgctattattttatatgctaaatgttggagacatttcttccatttacgaacttcgtggaaaagttgtttcaatgtcacaacaactaaggttacacaggtgtcctagtgctgtactaggtggtgatggttccactgtctccaaagtacagcaaggtgaaagacgtatcctcttctggagtatttattacttggatgtgtttagtgctcttcaacttggtgtcccgaggttgctcaaagactttgaaattgaatgcgctctgccagtaactagtgacgacgacagacaggtcaatttggcgggccaaatgatcgcattagaaggtaaagtgtctcagttttctttgtctgtgataagatttgccaaagttatggggaatattttagattcaacgttcaagagaggcatgactacatcactgactaaacaagcagctttggtgcatgagaacgcccttgataattggagacatggtttacagaaagatctctttttccaattagatgttaatggcacgattaatatggacgaattcaatcaacaaaagcaatactctaaatcactttcaccacgcactgccgcttttactcacaattccttggtgttaatgacgttgtattttatggctaaatgtatgattcacctaccggtcgtggctaccaagccacttgttgctgaggcaattcaaaccccaaccgataatcaaactgaaaacggatcggttgacagatctctgtcatcatatgtcctattacagcaagcgaccaatacgctcctaaacgttttgacagcgttgaactctatatatctgccgttacctataaatttggcaagaaccaagactcgttttggtttattcagcgcacgtggctcgttggaatataccaaaggtggtgcattattccaagacaacaaagccttattactagacttagtaaaagaactggagactgataagaaattagaactaccaggcaatacaagctggcatagcttgaaactatttgatctctcgattaacttgatcttgcaacctgtcaattcaaatccagagaagacagaaaagatgatacaaaagaaaattaactactacaacaagctaatggggcagcctactgttgccgttaagcgtaaacgagacccgaaggctacagaaaatacatcaaaaaaagttaaggttgaagatgatcatagtcaggacaatctgcacaacattactactggcgagaccactgatactgtccactctgaagagttagtcaaggacgtacccaaagaattgaatgtttatcctgaaaactacactacaattgaagaagcgttccaaatggatccagtattgaacactaatttgttcagtaacaccgatctcaagactttgttcaattcaggtatctttgaaaatgcgggcagcatccataacaacattaatgacaataacaataataataataatactaataatactaataataataatggttctagtaggaacattcacaatcttggtgcaggcattgaagacatagaccatgggatgagcttgagaagcaatgacgcttcgttgttgaatctttctaatgcactcggtaatcatggaaacagtgctgaggggatgaaggatggcacaagtgtgtcgaatttattgaatttaagtaccagtgacagtttattcaaagtacctagcaatggagactttttgaaggattattacattaacaatatgagtaacacaggactatctaacctgcacacttcttctgtgaacaagggtccttcattatcacagttgggctctctattcatgtcgagtgggtcgggaacaaatttaccatatagcaatgtacgtggagaatcgaaacacccatctggggtaaatctgaacaaacaacgtgcccaacctgcaatggatggtttctcatttgctgcagatgcatcactcgggctagcaccattgctagcctggtctccggacgctaaacctcaattgaatagtaacaatgggaatgacggtttgaaccctgcgacaggcattgtacttgaatctggcgacaatgattctactaatgcatcagtcgttcaattacaacagcaccaacagcagactcaccaccctccctcccacaacagctcatctattccaatgggaaagcaatccagcacatcagatcgtcaaaacagccatcatcaagataatgttggaagtttccattccatgcattctccgactattccagagcaaacctctgcacagggattgcatcaacatcagatgcttggcatgcctaacagcacactaaactcggataccaataccggtggtgctaatgttacaaatagtatttcaagcaccaatcgccgtggaccaagacgccgttggaataacgctgcatcatcgtcagaccctaattctgctggtgattcatcagtgtccgatttgctgcgctggcaaaatggaaat

SEQ ID NO: 110 - protein, 1445 aa, Kluyveromyces lactis
MVEKKDSAGRFNGQPSHGGPRFIRTLGSQSLSGLNPLSNAQQGVSQQQQHLSHHSHNVTDSDSPSIQDSGIPITSALIKKESPSHAVSGIPSNSNSINNNSKSNSNNNPSSVFSSRNNTSIQQLQQGPSPTLSNSESPVNASLLSSITTPLLHQTGSASHPPSNTGSSTNGTTTPSYRVAQACDRCRAKKIRCDGKRPQCTQCAAVGFECKISDKLSRRAFPRGYTETLEERVRELEAENRRLVALCDLKEEQLHLVSKYSNSKDENGVEIPSTEEEQILHELSKTNGGSLRVSSTNLYLLNKKASPGDDSHIESSEPSIPVRKVAITAPSPRIMSPRNSVADSDPSQTNTGNNDHIHSNNNNHNQNNSTDPYGISFEQNEAPGLPALKALSSLSKYKQGTQLATLVAVSVPRTTEEILFVPQLLARIGQIHGFTSKQCIYTASVLASLKENNISSIPPELEVLKNHNLWEIDDVLHFWKNVFKLDFMTHTAVDHSSTHLNFAEVEELMQLFFQDWYELIPLFDKNEFNSYYEKFKLNVTDPNFFVRKDDTVFNNRTRSISYKIFSCLLIIIVQMGMLSKIKRDKITSGKLSTLMKYYDKLMTHIWINPYFNSRNTSIQVLQCLSMLLFYMLNVGDISSIYELRGKVVSMSQQLRLHRCPSAVLGGDGSTVSKVQQGERRILFWSIYYLDVFSALQLGVPRLLKDFEIECALPVTSDDDRQVNLAGQMIALEGKVSQFSLSVIRFAKVMGNILDSTFKRGMTTSLTKQAALVHENALDNWRHGLQKDLFFQLDVNGTINMDEFNQQKQYSKSLSPRTAAFTHNSLVLMTLYFMAKCMIHLPVVATKPLVAEAIQTPTDNQTENGSVDRSLSSYVLLQQATNTLLNVLTALNSIYLPLPINLARTKTRFGLFSARGSLEYTKGGALFQDNKALLLDLVKELETDKKLELPGNTSWHSLKLFDLSINLILQPVNSNPEKTEKMIQKKINYYNKLMGQPTVAVKRKRDPKATENTSKKVKVEDDHSQDNLHNITTGETTDTVHSEELVKDVPKELNVYPENYTTIEEAFQMDPVLNTNLFSNTDLKTLFNSGIFENAGSIHNNINDNNNNNNNTNNTNNNNGSSRNIHNLGAGIEDIDHGMSLRSNDASLLNLSNALGNHGNSAEGMKDGTSVSNLLNLSTSDSLFKVPSNGDFLKDYYINNMSNTGLSNLHTSSVNKGPSLSQLGSLFMSSGSGTNLPYSNVRGESKHPSGVNLNKQRAQPAMDGFSFAADASLGLAPLLAWSPDAKPQLNSNNGNDGLNPATGIVLESGDNDSTNASVVQLQQHQQQTHHPPSHNSSSIPMGKQSSTSDRQNSHHQDNVGSFHSMHSPTIPEQTSAQGLHQHQMLGMPNSTLNSDTNTGGANVTNSISSTNRRGPRRRWNNAASSSDPNSAGDSSVSDLLRWQNGN

SEQ ID NO: 111 - DNA, 4299 bp, Saccharomyces cerevisiae
atggcaaataataattctgatcgacaaggtttggaacccagagtcattagaactctgggttcacaagcgcttagcggtcctagcatatctaatagaacttcaagttcggaggcaaaccctcatttttccaagaacgtgaaggaagcaatgatcaagacagcttctccgactcctttatctacacctatttacaggatagctcaagcttgtgacaggtgtcgatctaagaaaacaaggtgcgatggaaaaagaccacagtgttcgcagtgtgctgctgtcggatttgaatgcagaataagcgataaattactgaggaaagcgtatccaaaagggtacacagaaagcctggaagaaagagtacgcgaactggaggcagagaataagcgtttgctagctttgtgtgatatcaaagaacagcaaataagccttgtttcacagtcgcgaccacagacatcaacggataataccataaatggcaatttcaaacatgatttgaaagatgctccattgaatctgtcttctacaaatatctatttattaaatcaaacggttaataagcagctacaaaatggcaaaatggatggtgataatagcggttctgcaatgagtccattgggggcaccacctccaccgccacacaaagaccatctttgtgacggcgtttcctgtacaaatcatttacacgtcaagcctacttctacgagtttaaacgatccaaccgctatatcttttgaacaggacgaggcacctggtcttcctgcggtaaaggcattaaaatcaatgacgactcatcaacgtagcactcaattggcaactttagtttctttatccatcccaagatctactgaagaaattctgtttattcctcagcttttaactaggataagacaaatatttggtttcaactcaaagcaatgtttgtatacggtttcattattatcttcattgaaaaatagattgccagcaccacggcttctagcaccttcaacatcaaccaagttaaaggagaaagatgaagataaaaaacttgatgatgattcggcttttgtgaaaaggtttcaaagcacaaacctctccgagtttgtcgatttgaaaaagtttttaatttctttgaaatttaacattaactcgttttcaaagcaatcagaaaagccggctaatgatcaggatgatgaactactttccctcactgaaattaaagagcttttacacctttttttcaaattttggtctaatcaggtaccaattctaaacaatgaccacttcttaatatatttcaacaattttgttgaagtcgtgaagcatttatctacagaaaatttggagacgaataacactactaaaagtacagtcaccactaatcatgaaatatttgccctaaagcttctgatgatgttacaaatggggttactcgttaagattaaaatggaaaaaataaaatacactgtaccgaagaatccgaaggccaaatatgctagattgatggcatattatcatcagctttccctaataattcctaaaaatccttattttttaaatatgtccacaacttcattaccatccttacaattgttatctttggcatccttttattatttaaacgtgggtgatatttcggcaatctatggggtaagaggccgtattgtttctatggcacaacaattgagacttcacagatgtcctagtgccgtattaagtgtacactctaacccagttctacaaaaatttgagcaaagcgagaggagattactgttttgggcaatttattacgttgacgtttttgcctcattgcaacttggtgttcctcgtttacttaaggattttgatattgaatgtgcattaccaatttctgatgttgagtataaggatcagttatctatggaaaatgaaaaagcagataaaaaagctaaaaagattcaactgcaaggtcaagtttcaagcttttcattgcagataatcagatttgcgaaaatattaggtaacattctagactcgatttttaagagaggaatgatggatgaacgtataacttctgaagttgcattagtacatgaaaacgcactggataactggagaaatcaacttcccgaaatgtactactttcaaataactgtaaacggaactgtgaatttagacgagattagagcaaccaatcaaagaaatactgagaccaaatttgataagaaagacataatattatttgaaaagaagattctattgctgttttatttcttggccaaatctatgatacatttaccggttattgcaaccaaacctttgcctaagaatgttgataatgccacaaagaagaaacagtcaatgttcaacaacgactctaaaggcgcaaccaaccaggaccacatgatattagatgttgatatgacttctcctgctataaggacatcatcctcatatatcattttacaacaagctaccaatgcaacgcttacgattttccaggccattaattccatgtatttacctttgccattgaatgtatcaagaacgttaatcagattttctttgctctgtgctagaggttctttggaatataccaaaggtggtgcgttattcttagataataaaaatcttctcctcgacaccatcaaagatatcgaaaacgataggcttttggatttacctggaattgcctcttggcacacgctgaaactgtttgacatgagcatcaacctgttgttgaaagcacctaatgttaaggttgaaagactggataaattcttggaaaagaaattgaattactacaatagattgatggggttaccaccggccacaaccacatccttaaaaccattatttggctctcaatcgaagaacagcctggaaaatagacaaagaacacctaatgtcaaaagagaaaacccagaacacgagtatctttatggaaacgatagtaataataacaataattctgaagcgggtcactctccaatgacaaatacaactaatggtaataagagattaaagtatgaaaaagatgcaaaacgaaatgcaaaagatggcggtatatccaagggggagaacgcacataatttccagaatgataccaaaaaaaacatgtccaccagcaatctgtttccattttcgtttagtaatacagaccttactgcgctgttcacccatcctgaaggaccgaattgtacgaatactaataatggcaacgtggatgtgtgtaacagagcttctacagatgccacggatgccaatatagagaacttaagctttttaaatatggcaccattcttacagaccggtaactccaatataggtcaaaacacgattgagaataagcctatgcacatggatgcgatattcagtctaccaagtaatttagatctaatgaaggataatatggactctaaaccggaacaattagaacccgttattaagcaaaaccctgagaattcaaaaaacaaccaatttcatcagaaaggaaaaagtacgaatatggaaaagaataatctctctttcaacaacaagagtaactacagcctaacaaagctaatgagattgctgaacaacgataattctttctcgaatattagtattaacaactttttataccaaaatgatcagaactccgcgtcagcggatccgggaacaaataaaaaagccgttacaaatgcaggtgccaacttcaaaccaccttcaactggcagtaataccagccaaggcagtatccttggaagtacaaagcatggaatggacaactgtgatttcaacgatttaggtaattttaacaatttcatgacaaatgtcaattattctggggtcgactatgattacattgtagatgcatcacttgggttggctcctttattagtggatacgcccgatatctcaaataccaacacgacgtctactacgtcaaatcgaagtaaaaacagcatcatcctagatacgacatttaacgatgacttggatcggtcacgcatgaatgccagagaagtattgaatcctaccgactcaattttaagtcaagggatggtatcctccgtaagtacgagaaataccagcaatcaaagatctctttcatcgggcaatgattcaaaaggtgacagtagttctcaagagaactcaaagagtgcaactggcaaccagttggatacaccttctacactgtttcaaatgagaaggacctcttcagggccctcggcgtcccaccgtggtccaagacggcctcagaaaaatcgttacaatacagatcgatcaaaaagttctggtggcggaagttccaacacagataatgtatctgatttattccaatggcaaaacgccaaa

SEQ ID NO: 112 - protein, 1433 aa, Saccharomyces cerevisiae
MANNNSDRQGLEPRVIRTLGSQALSGPSISNRTSSSEANPHFSKNVKEAMIKTASPTPLSTPIYRIAQACDRCRSKKTRCDGKRPQCSQCAAVGFECRISDKLLRKAYPKGYTESLEERVRELEAENKRLLALCDIKEQQISLVSQSRPQTSTDNTINGNFKHDLKDAPLNLSSTNIYLLNQTVNKQLQNGKMDGDNSGSAMSPLGAPPPPPHKDHLCDGVSCTNHLHVKPTSTSLNDPTAISFEQDEAPGLPAVKALKSMTTHQRSTQLATLVSLSIPRSTEEILFIPQLLTRIRQIFGFNSKQCLYTVSLLSSLKNRLPAPRLLAPSTSTKLKEKDEDKKLDDDSAFVKRFQSTNLSEFVDLKKFLISLKFNINSFSKQSEKPANDQDDELLSLTEIKELLHLFFKFWSNQVPILNNDHFLIYFNNFVEVVKHLSTENLETNNTTKSTVTTNHEIFALKLLMMLQMGLLVKIKMEKIKYTVPKNPKAKYARLMAYYHQLSLIIPKNPYFLNMSTTSLPSLQLLSLASFYYLNVGDISAIYGVRGRIVSMAQQLRLHRCPSAVLSVHSNPVLQKFEQSERRLLFWAIYYVDVFASLQLGVPRLLKDFDIECALPISDVEYKDQLSMENEKADKKAKKIQLQGQVSSFSLQIIRFAKILGNILDSIFKRGMMDERITSEVALVHENALDNWRNQLPEMYYFQITVNGTVNLDEIRATNQRNTETKFDKKDIILFEKKILLLFYFLAKSMIHLPVIATKPLPKNVDNATKKKQSMFNNDSKGATNQDHMILDVDMTSPAIRTSSSYIILQQATNATLTIFQAINSMYLPLPLNVSRTLIRFSLLCARGSLEYTKGGALFLDNKNLLLDTIKDIENDRLLDLPGIASWHTLKLFDMSINLLLKAPNVKVERLDKFLEKKLNYYNRLMGLPPATTTSLKPLFGSQSKNSLENRQRTPNVKRENPEHEYLYGNDSNNNNNSEAGHSPMTNTTNGNKRLKYEKDAKRNAKDGGISKGENAHNFQNDTKKNMSTSNLFPFSFSNTDLTALFTHPEGPNCTNTNNGNVDVCNRASTDATDANIENLSFLNMAPFLQTGNSNIGQNTIENKPMHMDAIFSLPSNLDLMKDNMDSKPEQLEPVIKQNPENSKNNQFHQKGKSTNMEKNNLSFNNKSNYSLTKLMRLLNNDNSFSNISINNFLYQNDQNSASADPGTNKKAVTNAGANFKPPSTGSNTSQGSILGSTKHGMDNCDFNDLGNFNNFMTNVNYSGVDYDYIVDASLGLAPLLVDTPDISNTNTTSTTSNRSKNSIILDTTFNDDLDRSRMNAREVLNPTDSILSQGMVSSVSTRNTSNQRSLSSGNDSKGDSSSQENSKSATGNQLDTPSTLFQMRRTSSGPSASHRGPRRPQKNRYNTDRSKSSGGGSSNTDNVSDLFQWQNAK

SEQ ID NO: 113 - DNA, 1824 bp, Saccharomyces cerevisiae
atgtttaaccgtaccactcaactgaaatccaagcatccctgttccgtgtgtacgaggcgaaaagtcaaatgtgatcgtatgataccgtgtggaaactgcaggaagagaggacaggactccgaatgtatgaaatcaacaaaactaataacggcttcatcttccaaggaatatctccctgacctattgttattctggcaaaattatgaatattggataacgaatattgggctgtacaaaacaaaacaaagagatcttactagaacaccagctaatttggatactgatactgaagaatgtatgttttggatgaattatcttcaaaaagaccaatcattccaattgatgaactttgctatggaaaacttaggtgctttgtattttggttccattggagatatcagtgaattatatttgagggtggaacagtactgggatagaagggcagacaagaatcacagtgtagacggcaaatactgggacgcactaatatggtctgtctttaccatgtgcatttattatatgccagtcgagaagttagcagaaatattttcagtatatcctctccatgaatatttgggtagcaacaaaaggctcaattgggaagatggtatgcaattagtcatgtgccaaaattttgcacgctgctcattattccaattgaaacaatgtgatttcatggcgcatcccgatataaggctcgttcaagcatatctgattttagccactacaactttcccctacgatgaaccgttgttggcaaattcgctcctaacacagtgcatccatacctttaaaaattttcatgtggatgactttagacctttacttaatgatgaccccgttgaaagcatcgctaaagtaaccttgggaagaatattctatcgcctgtgtggatgcgattatcttcaatcggggccacgcaaaccaattgcacttcatacagaagtatcctccctattacaacatgcagcatatttgcaggatttgcctaacgttgatgtttacagggaagaaaacagcacagaggtcttgtattggaaaatcatctcattagacagagatttagatcaatacttgaacaagagttctaaacctcccttaaaaacattggatgctataaggagggagctcgatatttttcaatacaaagtagattcgttggaagaagattttagatcaaataacagcagatttcaaaaatttattgcactttttcaaatatctactgtttcctggaaattgtttaagatgtatctcatttattatgataccgcagattcactactaaaggttatacattattctaaggtaatcattagtcttattgttaataacttccatgcaaaaagtgagtttttcaacagacatccgatggtgatgcaaaccattacgcgcgtggtctctttcatctccttttaccaaatttttgtggaatcggctgctgtcaaacaacttttagtagatctaactgaacttactgcaaatctgcccacaatattcggttcaaaactagataaactagtttacttgaccgaaaggctcagtaaattaaaacttttatgggacaaggtacagcttctagattcaggtgattcgttttaccatcctgttttcaaaatactacaaaatgatattaagataattgagttgaaaaatgatgaaatgttttctctcataaaaggactcgggtctttggtaccgttgaataagcttagacaagaatcgttgcttgaggaagaggacgaaaacaatacggaaccaagtgacttcagaactattgtagaagagtttcaatccgaatataacatttctgacatactttcc

SEQ ID NO: 114 - protein, 608 aa, Saccharomyces cerevisiae
MFNRTTQLKSKHPCSVCTRRKVKCDRMIPCGNCRKRGQDSECMKSTKLITASSSKEYLPDLLLFWQNYEYWITNIGLYKTKQRDLTRTPANLDTDTEECMFWMNYLQKDQSFQLMNFAMENLGALYFGSIGDISELYLRVEQYWDRRADKNHSVDGKYWDALIWSVFTMCIYYMPVEKLAEIFSVYPLHEYLGSNKRLNWEDGMQLVMCQNFARCSLFQLKQCDFMAHPDIRLVQAYLILATTTFPYDEPLLANSLLTQCIHTFKNFHVDDFRPLLNDDPVESIAKVTLGRIFYRLCGCDYLQSGPRKPIALHTEVSSLLQHAAYLQDLPNVDVYREENSTEVLYWKIISLDRDLDQYLNKSSKPPLKTLDAIRRELDIFQYKVDSLEEDFRSNNSRFQKFIALFQISTVSWKLFKMYLIYYDTADSLLKVIHYSKVIISLIVNNFHAKSEFFNRHPMVMQTITRVVSFISFYQIFVESAAVKQLLVDLTELTANLPTIFGSKLDKLVYLTERLSKLKLLWDKVQLLDSGDSFYHPVFKILQNDIKIIELKNDEMFSLIKGLGSLVPLNKLRQESLLEEEDENNTEPSDFRTIVEEFQSEYNISDILS

SEQ ID NO: 115 - DNA, 1944 bp, Saccharomyces cerevisiae
atgatgttggagccttcacctccacctttaacaacaacggtaacaccctcccttccgtccagtttaaagaaatctgtgacagataatgaccagaataataacaacgtgcccaggaagagaaaactagcatgccagaattgccgtagaagaagaaggaaatgtaacatggaaaagccttgttcaaactgtatcaagtttcgtaccgaatgtgtattcactcaacaagacttaaggaacaaaagatattctacgacttacgtagaagctttacagagccagattcggtctttgaaagaacagttgcaaatattaagttcctcgtcttccacaattgctagcaatgctctctcctcgttaaaaaacaacagtgatcatggtgatgctcctaatgaaaaaatcttaaagtatggcgaaacagcacaatcagcactaccatcatctgaaagcaacgatgagaatgagtctgatgcgttcaccaagaaaatgccttccgagagccctccaccagttggcacaaatagtatatatccatcaaattccttgtctataataaaaaagaagacggatggaagcacaagatatcagcaacagcaggtcagcctaaaaaatttatcaagaagtccccttatcttaagatcgttgtcactctttttcaaatggctatacccgggacattaccttttcattcatagagaaactttcttaagtgctttcttcggtgatactaacactaaaagttactattgttccgaagaattggtatttgcaatcgctgcattgggatctttgatttcatacaaatcagaaactgagctttttcaacaatctgaagtgttttatcaaagagccaagacgatagtactcaaaaaaatttttcaactggaagattcttcgttagctgaatcgtcgtcctcttcgaaattagcaatcatccagactctattgtgtttggcattttatgacattggaagcggagaaaaccccatggcttggtatctttctgggctggcatttaggattgcccacgaaatcggcctacatttgaatccagaagcatggagtaatgtttatgaagacgagctgtcaataatggattttgaagtgagaagtagaatttattggggctgctacattgctgatcatttaatagcgatcctctttggaagatcaacttccttgcgtttgtccaattccactgttccagaaacagacgagctacctgaaattgagactggtatagaggagtacatatatgacccaaaagtaatattgtccactgcaaaccccttgaagaaactgattgtgttatcgagaataacggagatttttgcatccaagattttcagcccaaacgaaactctacttcaaaggagtgaatacttggccaaatttaatctggaggtatacaattggagaagggatttgccccctgaactacaatggaccaagaggtcattgatggaaatgacagattttaacccaaccatagcttacgtatggtttcattactatatcgtgctaatttcctataataaacctttcatatacgaaatcaaacaaagccgggaattggttgaaggttatgttgatgaactgtattatcttttaaaagtttggaaaaataaatttaagacgtttgagaaggccacaatttacatgatttattctgcgattttagccatccaatgcatgaagtccaacttgattaaaaaggatagaaaacaagacttcttaaattttttaagtgcgcctaccctgaattacgaacttgctagaaaattcatagaaaactctgaagatgctttgcataattcagaaactatggatttattagggactctatctcacggtaacgattttgccttagagtacaattttgactttactttattgaatgagattgatatgctgattggtggaaacaccaatgatggtttgtcgaag

SEQ ID NO: 116 - protein, 648 aa, Saccharomyces cerevisiae
MMLEPSPPPLTTTVTPSLPSSLKKSVTDNDQNNNNVPRKRKLACQNCRRRRRKCNMEKPCSNCIKFRTECVFTQQDLRNKRYSTTYVEALQSQIRSLKEQLQILSSSSSTIASNALSSLKNNSDHGDAPNEKILKYGETAQSALPSSESNDENESDAFTKKMPSESPPPVGTNSIYPSNSLSIIKKKTDGSTRYQQQQVSLKNLSRSPLILRSLSLFFKWLYPGHYLFIHRETFLSAFFGDTNTKSYYCSEELVFAIAALGSLISYKSETELFQQSEVFYQRAKTIVLKKIFQLEDSSLAESSSSSKLAIIQTLLCLAFYDIGSGENPMAWYLSGLAFRIAHEIGLHLNPEAWSNVYEDELSIMDFEVRSRIYWGCYIADHLIAILFGRSTSLRLSNSTVPETDELPEIETGIEEYIYDPKVILSTANPLKKLIVLSRITEIFASKIFSPNETLLQRSEYLAKFNLEVYNWRRDLPPELQWTKRSLMEMTDFNPTIAYVWFHYYIVLISYNKPFIYEIKQSRELVEGYVDELYYLLKVWKNKFKTFEKATIYMIYSAILAIQCMKSNLIKKDRKQDFLNFLSAPTLNYELARKFIENSEDALHNSETMDLLGTLSHGNDFALEYNFDFTLLNEIDMLIGGNTNDGLSK

SEQ ID NO: 117 - DNA, 2952 bp, Colletotrichum lagenarium
atggttttctgcgcctattgtgggaagtccttcaccaggaaggagcacctggagagacatatccctagccacaccaatgtgaagcctcatcgctgcagtgcttgccaactatcctttgccagacgagaccttcttcagagacatcactcgacttaccatgaggcgcgggatcccatggagccgttgcccggcggtgtgcccaccgtcgctgggagaacgcccattgcttgccaaaattgcgccaatgcgaagacaggctgtgacaagcgggttccgtgctcgcgatgtgccgagaagaacttgccctgcgccgcaaggttcgccaggagatcgtcgaaagctgctgtgagagcagcccaggccagcgcagctttccaacaacagatgatgccaaccgtgcctcaaccaccgcagcctgctcagcccgtggccttcatggacctggacccgacgctgccaaagccagacgacccgagcaagatgtcgacggggtcgcctatcgcgaccatggatccccgcatggtcgagaacaccatgaggaagagctcaccaccgcattcgcaccgcagtcccgactcgttcccgtcacctcacagccgggtggacggactcgacgagttcatgcagctcaacaacgacttcatcactcccgacaccaactaccaagatatgctcgtctggcccgagtatcctctggatctcgacatttactccaaccaattacccatgacacgacctgacattccgatgccgagtttcacagaactcagcgacatgtcgtcgacttcggcctctgagcccatgacggcctcctcttcaagaggatctattcataccaggagtacaagcatcatgtcgactgccgaattcgacacgacgatgaagcctgcggaatcttccgtcggcattgtgtccgactccatgatccccgagtttgaagtggtcatcgccgccgaagattcgtggccgctggcgcgttgcaaccccccaatttactcgggtacctgtccacgaacggccattgtccacctcgagtgcctcgagagaaagtcaaaggaggacggtacctggagctccctggagaagtacttggagaaggttgactgggactcgactgatgcttctgtcgtgccgctcacctctcgcacacgcgacagaatgctagcaatcacacagtcattccttcaaaaggcgctcgagattcaccgcagcggcctcaacaatgggttctcaaagacgggatacgccaccccgagcgagttcaactttatcgtccttccgccgcccaagatcctggaatacttcttgcgcagctacgttcgcagcctgcagtactactatcctctcatcgtcgctggatgtgtcgaccccaacgagatgcttctcaacaaccaggcgtcgaccctcctcgtcctcttgatgattgcccaaggcgcgtccaacgtgcccatggccgaggcgaggtatctcgcagcagggctcacggaaacgtgtcgcatctcgcttttcgacattatagaaaaggacgttgagctctctgccgacccgatcgctctgcgatgcgccctcctcttcactctgctcggggcatggagtggcgacaaatggttgatggacatttccatgggtcagcggggaatgtacctgtcgatgcttagacacgccggcatgctagagccacagccgtcaatgatcccgactctgaacagcaccaccagcaccgagctgcaatggcgagcatggctgcatcgtgagatgcagaacagactcgtgtacaactgggtcatgtgcgaccaggaattgagcctatttcacgacacgccgcctcaactggccatcaccgaccttcagtgccctctcccaagccctgaggttctctggcttgcttccaactcggagcagtggttcgccaacgtgcaaaacatttacgggtgcaccgccaacgtaaaccctcaactcctcagtagcccgtctctcactccgtctctttgcgagctcttccaggactttatccacgataaccttacccgtcgccagggaagcctctcgccccagcaactgcgtctcctgctccacccgctgcaggctctgctgtgccacctgagacagatgttctcctgcttttctgacgttctttcgacgcgccgggcgacatcccgaaccgtcaccaaggcgagcaccatgctccgcctggaggaggtccaggcgcttctccagaaatggtacgaacttaccatgtcctcttccaagaacgacccggactgcggcaccacccgctgcaatctggtcctctaccaccttatttccctgaatgccgtcaccaacttccccgagattgagcgcctcgctcgtcgggacggctttgacggctcgttctgggaactgagcttgcgccacaagcggtgcgtctacaaccgcgaggaggccatcttccactgcggccaggtcctccggctgcttcgatccatgccagccgaccgtcggccgtgctggtggccggcgggcgtctaccgcgcaaccctcatcctctgggccgacagcgtgtcgcgcctcgatcccaacttccacaaagcccaggctcagcagcagtcttcttcgccagcatcgcagcatcaggatcacagaccggaagagctcagcggcgcaggcgcctccaacgcggcgacgagcggccaatcttttggcagcggcaacatcgtcgccattgatcaggtcacccccgaggacccagccgtcatctcctatctgtggagcggcggcgacggtaccccggttctcactcgccgcgacggcaccacgctgggtctcgacaagccatccgaagtgatcgggtacggcatcatgtccatcgaagagggtgtcacttgccgtgtcggcgatggcatcaagcgcaagctcatcacgctcaacagcaactggaacgtcgatggtctgggtgccacgacgaccgcc

SEQ ID NO: 118 - protein, 984 aa, Colletotrichum lagenarium
MVFCAYCGKSFTRKEHLERHIPSHTNVKPHRCSACQLSFARRDLLQRHHSTYHEARDPMEPLPGGVPTVAGRTPIACQNCANAKTGCDKRVPCSRCAEKNLPCAARFARRSSKAAVRAAQASAAFQQQMMPTVPQPPQPAQPVAFMDLDPTLPKPDDPSKMSTGSPIATMDPRMVENTMRKSSPPHSHRSPDSFPSPHSRVDGLDEFMQLNNDFITPDTNYQDMLVWPEYPLDLDIYSNQLPMTRPDIPMPSFTELSDMSSTSASEPMTASSSRGSIHTRSTSIMSTAEFDTTMKPAESSVGIVSDSMIPEFEVVIAAEDSWPLARCNPPIYSGTCPRTAIVHLECLERKSKEDGTWSSLEKYLEKVDWDSTDASVVPLTSRTRDRMLAITQSFLQKALEIHRSGLNNGFSKTGYATPSEFNFIVLPPPKILEYFLRSYVRSLQYYYPLIVAGCVDPNEMLLNNQASTLLVLLMIAQGASNVPMAEARYLAAGLTETCRISLFDIIEKDVELSADPIALRCALLFTLLGAWSGDKWLMDISMGQRGMYLSMLRHAGMLEPQPSMIPTLNSTTSTELQWRAWLHREMQNRLVYNWVMCDQELSLFHDTPPQLAITDLQCPLPSPEVLWLASNSEQWFANVQNIYGCTANVNPQLLSSPSLTPSLCELFQDFIHDNLTRRQGSLSPQQLRLLLHPLQALLCHLRQMFSCFSDVLSTRRATSRTVTKASTMLRLEEVQALLQKWYELTMSSSKNDPDCGTTRCNLVLYHLISLNAVTNFPEIERLARRDGFDGSFWELSLRHKRCVYNREEAIFHCGQVLRLLRSMPADRRPCWWPAGVYRATLILWADSVSRLDPNFHKAQAQQQSSSPASQHQDHRPEELSGAGASNAATSGQSFGSGNIVAIDQVTPEDPAVISYLWSGGDGTPVLTRRDGTTLGLDKPSEVIGYGIMSIEEGVTCRVGDGIKRKLITLNSNWNVDGLGATTTA

SEQ ID NO: 119 - DNA, 2727 bp, Haematonectria haematococca
atgtcttcaggggacgcgccgccgcaggcgcaaccgcaacctcaccagcaagaacagccgaaccagcgacagtcgtcgacaccagcgccctcggccgcgcccgtgccgcccgctcccagcacgtcgacgtcaaactcggccggaggagtgagctttcggagacaacgagcgtcacgcgcatgcgagacctgccacgcgagaaaggttcgatgcgacgcggcgagccttggtgtaccttgcaccaactgcgtagccttccagattgaatgtcgcattccaaaccctaaacgcaagaagacccaaggcacaggtggtagtcagaccaacaaggattcagatagtgaccgaggcgatggcaccgaggatccttcacctcgtcctgtcgctccaactgcggccagcttcgctcctcgaacgccctctgtcttccactcgcacaatggcactccaccaaccacattgacagaagctcaggctcggaaggaagaggttgatagtggcacatatctcgatcttgttatgaagcccaagttcactcgtgctccgatcaccgaagctgggcgagtcgcgtacctcggcgaatcttccaatctcacccttctcgttcacgatcgtcaaggctcggccgatgttgttcactacccgctgcccgagaacgttcgcggctctcgagcccgtctcactgagctcgacaatgttgaaatcgacattttacatcaaagaggagcattcctgcttcctccgcgcgcactctgcgacgaactcattgacgcctacttcagctgggtgcatcccatcgtgcccgtcattaaccgcacccgcttcatgcgacagtatcgagatcccaaaaaccctccgtcgctgctgcttcttcagtccgtcctccttgccggaactcgggcctgcaacaacgctcagctgatggacgcgaatggttctacgacgccggctgctctaactttctacaagcgcgccaaggccctgtacgatgcaaactacgaagatgaccgtgtaacaattgtccagtcgctacttctcatgggctggtactgggaaggacctgaggacgtcaccaaaaatgtcttttactggagccgcgtggcgaccattgttgctcagggctcgggcatgcatcgatccgtcgaacagtcacagctaagtcgctcagacaagaggctgtggaagcgcatctggtggacgctcttcactcgcgacagatcagtggctgtggcattgggtcgacctgttcatatcaacctcgacgatgcagacgtggaaatgttgacggaggatgatttcatcgaggacgaacaagaccgcgtgagcgagtatccgcccgacccaatccacgtccagttcttcctcgagtatgttaagctctgcgagatcatggggttggtgttatcacaacagtactcggtagcctccaagggccggcaacgaaatgccatcgatctcacccacagcgacatggcactggccgattggcttcagaattgcccaaagatcgtgtactgggaagtgccacgccatcacttttggtccgctctccttcactcgaactattacacgacattgtgtctcctacatcgagcccatatgccgccaggcggctctgcacggttccccgatccttcgccatacccgtcgcgaaacatcgctttccaggcagcggccatgatcacatcgattgtcgaaaacctcgccgctcacgatcagctacgatactgcccggcctttgttgtttacagtctattctccgctctaatcaggcatgtttaccaaatgagatcacctgtgccttcaattcagcaggtgacacaggaccggttgcgcagctgcatgtcggctatgaaggagatatcacgagtctggctggtgggcaaaatggtctatgctctctttgagtccatcattggaaacaaggtgctggaagagcgactgcaaaaagctgagggcaagcgacatcgaaagatgcgtcaaactcttacaacacaactggaacagcatagtcgacagcaagaagcgcccaaacggaaatacgacgagatggccatcgactttggcaccaacactcctcagcctcaggagtcatatgagaggtcacgcccacagacgccgagtgccgtcaaggcagagacgagttcgatgcagccgccgcctgtaagctcgccaggtgcacgacagagtgcggcagacacatttatgggaggaacgaactcgagaccacagacccgaccagcgacaccctttaacccctcattctcggtgccgccaacgcctccagatctgtaccttgtgaccagaaactcgccgaacctatctcagtccttgtgggagaatttccagccagatcagctgtttccggacagcgctgctatgccagcgttcccaaacttatcgccaatccagacacacgcttccctcgatcatagcgcaatgggaccagtaccaggcaacgggcaaggcgggatgcccaaccagcaggcggggcagttccagcagcgagggaacggaattctaccacagggtttccaagggcataccaacatgtggcaaccaaatcttgatccgaatttgccggaagggcagagtcctgatagctggagcagcacatcgggccaaggccaagcagtcccgacgacacttaatgtagaagactggttccagttcttcggcatcaatggcactgatccaaatcaccttaatcttgacataccattgggc

SEQ ID NO: 120 - protein, 909 aa, Haematonectria haematococca
MSSGDAPPQAQPQPHQQEQPNQRQSSTPAPSAAPVPPAPSTSTSNSAGGVSFRRQRASRACETCHARKVRCDAASLGVPCTNCVAFQIECRIPNPKRKKTQGTGGSQTNKDSDSDRGDGTEDPSPRPVAPTAASFAPRTPSVFHSHNGTPPTTLTEAQARKEEVDSGTYLDLVMKPKFTRAPITEAGRVAYLGESSNLTLLVHDRQGSADVVHYPLPENVRGSRARLTELDNVEIDILHQRGAFLLPPRALCDELIDAYFSWVHPIVPVINRTRFMRQYRDPKNPPSLLLLQSVLLAGTRACNNAQLMDANGSTTPAALTFYKRAKALYDANYEDDRVTIVQSLLLMGWYWEGPEDVTKNVFYWSRVATIVAQGSGMHRSVEQSQLSRSDKRLWKRIWWTLFTRDRSVAVALGRPVHINLDDADVEMLTEDDFIEDEQDRVSEYPPDPIHVQFFLEYVKLCEIMGLVLSQQYSVASKGRQRNAIDLTHSDMALADWLQNCPKIVYWEVPRHHFWSALLHSNYYTTLCLLHRAHMPPGGSARFPDPSPYPSRNIAFQAAAMITSIVENLAAHDQLRYCPAFVVYSLFSALIRHVYQMRSPVPSIQQVTQDRLRSCMSAMKEISRVWLVGKMVYALFESIIGNKVLEERLQKAEGKRHRKMRQTLTTQLEQHSRQQEAPKRKYDEMAIDFGTNTPQPQESYERSRPQTPSAVKAETSSMQPPPVSSPGARQSAADTFMGGTNSRPQTRPATPFNPSFSVPPTPPDLYLVTRNSPNLSQSLWENFQPDQLFPDSAAMPAFPNLSPIQTHASLDHSAMGPVPGNGQGGMPNQQAGQFQQRGNGILPQGFQGHTNMWQPNLDPNLPEGQSPDSWSSTSGQGQAVPTTLNVEDWFQFFGINGTDPNHLNLDIPLG

SEQ ID NO: 121 - DNA, 2646 bp, Haematonectria haematococca
atgaacgcggaaacgccagaaggctcggctgctccgccctcgccggcgtcgacatcagcaaagactgtcaccgacaagaccaacaagaagcgagcctcgccatccggcgactcagaacagcccacaaaggtcaccaagcgacgagctgcccgtgcctgcgtgtcctgccgtgcccgaaaggtccgctgcgacgtggtcgaaggagccccttgtggaaactgtcgctgggacaatgtcgagtgcgttgtacaagagagccgcagacgaaagaagaatcttcttaccgccagcaccgcgggccagcccgtctccactgaagcccaattgcgctgcaagaccgcagccagcaatcccatgggcatgagcacagccgatcttcggcgtcctagcagcggctctgcaatctcgacgagcagcattgacgggcccagcagcttcctgagcaattccggacttgacaaccatgtccctcacatgatctaccaacgatctgggtaccgccacgaccctgttctgctaaacaagctgcactccaatgatggcaaccctcagcgtcccgtgtggtccaataacctcatgacaactccttccgtctttgacagtctgcgcactttcaggttcatcagctcgcttgaggagcaggattcgactgctcagctccctgcttttctgcgccccctaccaaccaagattgccgccgaggatgtcaagtatcttcagatcaagggtgccctgtctgtgcccaccctgccgcttcagaatgccctcctgcaggcttacgtcgaatacgtccacccgtatatgccgctcatggacctgaacagctttctcggcatcataaacacacgtgatggtcagaatggccagaccagtctctttctctaccaagcggtcatgtttgccgcgtccgctttcgtggatatgaagtatcttcgcgagggtggttacactacacggaaggcggctcgcaagtcctttttccagaagaccaggcttctctacgattttgattacgagtcagaccgccttgtcctcgtccaggcactgctcctgatgacgtattggtacgagacccctgatgatcagaaagacacttggcactggatgggtgtggccatctcgttggctcacaccattggcctccaccgcaaccctggatcgacgagcatggccccggccaagcagaagttgtggaagcgaatctggtggtcgtgcttcatgcgagaccgtcttattgccctgggtatgcgacgacccactcgaatcaaggacgaggactttgacgtccccatgctcgaggagagcgattttgaaatcgaggtcctagccgacgacaacaccgtcatccccgctagctgcacgttggtccgcaatctggatatgcagcgagaactggccatcatgtgtatctccaaggcccaactctgcgtgtgcatcagccacatgctcaaggcacagtactcggttttgatccgggacaagatgaagcctgagaatacgaccaacagcaccatgatgctgtttcctaacaagcagctagataacgtcgagggcgttactgaggtcgaccacgagctcatggcatgggcagagtccctcccaacttgctgccagtaccgtaccctgactcctttggatgtcaaggatggacgatctaccattgccgtgcagcgcacgctgctccacatggtttactacacgactatttcggccctccatcgacctcagtttctgccgtcgtcgcctctgcaggcccctacgacatcacgccaggtccaagacatgtcacgactgcgagtgcgtgatgccgccatgcacattactcgaatggccacggaacttcaccaatgccgcctggagcggttcttgcccacgactggtgttaccgttattctcccagccatgattattcacctgctcgagatgaagaaccccgcaccacaggctcgcgagcgtgccactcgaggtttccgccaatgcatgagagtgatggaaaagcttcgagaagtgtacgcggctgccgactacgcaacgggcttcctcgatgctgctcttcgcaaggccgctatcgatattaatgctagtgttggcccctcaaccttggccatgatgaagcgagtgccagtcgagttcagcgctcagacgccaccacccgagaacgcgccttacatgaccgctgccgagtctctctttaatgagaggccgaaggagcatcgaccacagccgaccccgaccatgatgccacccaacacagtcaatgctgcagccttggagctctctacgaactcgccgccccagactgaactggaggagtcccctgctggcctgacacccagcgtcagcgccgcatccgaggagatccagttggatgtcggaaacatggatcttgatttcatgcagggtcacgatgagtttgactggaacgccgttgccggaactgactttgatgttgatcaatggcttcagttccctcctgagggtgtcaccaaccaggatgacaacctgattgctggtgtacttggacgaggagtcgaggagcctaccatgtcggctgagcaagctctgaactgggctatcaacgccgaggctgatgccacagccaggcagccagatggccgcgtccagggagaagttcctgcccaggcg

SEQ ID NO: 122 - protein, 882 aa, haematonectria haematococca
MNAETPEGSAAPPSPASTSAKTVTDKTNKKRASPSGDSEQPTKVTKRRAARACVSCRARKVRCDVVEGAPCGNCRWDNVECVVQESRRRKKNLLTASTAGQPVSTEAQLRCKTAASNPMGMSTADLRRPSSGSAISTSSIDGPSSFLSNSGLDNHVPHMIYQRSGYRHDPVLLNKLHSNDGNPQRPVWSNNLMTTPSVFDSLRTFRFISSLEEQDSTAQLPAFLRPLPTKIAAEDVKYLQIKGALSVPTLPLQNALLQAYVEYVHPYMPLMDLNSFLGIINTRDGQNGQTSLFLYQAVMFAASAFVDMKYLREGGYTTRKAARKSFFQKTRLLYDFDYESDRLVLVQALLLMTYWYETPDDQKDTWHWMGVAISLAHTIGLHRNPGSTSMAPAKQKLWKRIWWSCFMRDRLIALGMRRPTRIKDEDFDVPMLEESDFEIEVLADDNTVIPASCTLVRNLDMQRELAIMCISKAQLCVCISHMLKAQYSVLIRDKMKPENTTNSTMMLFPNKQLDNVEGVTEVDHELMAWAESLPTCCQYRTLTPLDVKDGRSTIAVQRTLLHMVYYTTISALHRPQFLPSSPLQAPTTSRQVQDMSRLRVRDAAMHITRMATELHQCRLERFLPTTGVTVILPAMIIHLLEMKNPAPQARERATRGFRQCMRVMEKLREVYAAADYATGFLDAALRKAAIDINASVGPSTLAMMKRVPVEFSAQTPPPENAPYMTAAESLFNERPKEHRPQPTPTMMPPNTVNAAALELSTNSPPQTELEESPAGLTPSVSAASEEIQLDVGNMDLDFMQGHDEFDWNAVAGTDFDVDQWLQFPPEGVTNQDDNLIAGVLGRGVEEPTMSAEQALNWAINAEADATARQPDGRVQGEVPAQA

SEQ ID NO: 123 - DNA, 1164 bp, Candida albicans
atgagttcaatacccaatatcaattggaatgaccctaacaatggtaaatccaatacctctcgtcaatcacaaccacaaccacagctaccaagtaatgtatctccccctaatagcagagcagtgccaacgtcagggtcaataggcggacctcagtatgggagctcacaattttcaaatgagtattctcgaaatcctaatacaataggcggtccaccatttccattacagctgaaccagcgagggtatatgccaaacactggttatccggtacaacaaacggcgcaacagagaagcggcgataaactacagcaggttcattcccaacaacaacaacaacaacaacaacaacaacaaccattgtaccagcaatatccgccacaatctgtaggttacctagcgggtgatgtgtacaatccccaacaccaagaatatgtgcaaatgaatcaattgcccaatcagcattacaatttgcaacaaagacaacaggcacaaggacaacaactcaaactgcaactaaacgagcaaaatgccatgatgtctgcctcgactcaacaatatcctgtccaggattttacaaatccttaccccaatgcacagaatcccgcagaacaacagcaacagcaacaacctcttcgaacccagtcacaacaatgggacggctaccaatctcaacctttgtattctgctgctggtaatactataccatcctcaatccagcagcaaataccaccacagaatttgtctccatcagagcagcaacaagtcaagcaacaacagccactgccgccagaacaaggaacaaagaaaaaacctggtagaaaaccaaaattaagaaaattatcggaactgagttctgaaacaccacaagttccaaaaacagcatccagttcttcgagctcaccaactgcagtcaattctggtaaaccaattacaaaaagatcgcgtatgggatgtcttacatgccgtcaaagaaagaaacgttgttgtgaaacaagaccaaggtgtactgagtgcacaagacttcgtttgaactgtacatggcccaaacctggtacagaacacaaaaacaaacctaaggatcaaaaggatgacgaaaatacaattgaacatgccgagtttggtagaatcaaagttttgagaggtattgttgaatacagaagtaaa

SEQ ID NO: 124 - protein, 388 aa, Candida albicans
MSSIPNINWNDPNNGKSNTSRQSQPQPQLPSNVSPPNSRAVPTSGSIGGPQYGSSQFSNEYSRNPNTIGGPPFPLQSNQRGYMPNTGYPVQQTAQQRSGDKLQQVHSQQQQQQQQQQQPLYQQYPPQSVGYLAGDVYNPQHQEYVQMNQLPNQHYNLQQRQQAQGQQLKSQLNEQNAMMSASTQQYPVQDFTNPYPNAQNPAEQQQQQQPLRTQSQQWDGYQSQPLYSAAGNTIPSSIQQQIPPQNLSPSEQQQVKQQQPSPPEQGTKKKPGRKPKLRKLSESSSETPQVPKTASSSSSSPTAVNSGKPITKRSRMGCLTCRQRKKRCCETRPRCTECTRLRLNCTWPKPGTEHKNKPKDQKDDENTIEHAEFGRIKVLRGIVEYRSK

SEQ ID NO: 125 - DNA, 2910 bp, Saccharomyces cerevisiae
atggaccctcaccaatcaccagctgataatgccgcatcgcctacgaagagcgtgaaggcaaccactaaaaattcgtccacgaataataatgtcaatagcaacaacagcaataataacagtaaccatgatatactgaattttaatgataactatactaccattctgcaacatttggcaaacgaccatcctaatatactgagggagaaaggaggatcacaacaacaacagcatcagcagcagcaacaacagcaacaacagcagcaacaacagcagcaacaacagagcttggatacccttttgcaccattatcaaagtttactctccaagagtgataatgcaatagcctttgatgacaatgttagtaacagcgcagatcataatggcagtaatagcaacaataataacaacaataatgacatatctagtcccggtaatctgatgggatcttgcaatcaatgtagattaaagaaaacaaagtgcaactattttcccgacctaggcaactgtctcgaatgtgaaacgtcaagaactaaatgcaccttcagtattgctccaaattatttgaaaagaacgtcctctggggcaaacaataacatgccaacctcttcaaactccaaacgaatgaaaaattttgaagactattcgaatcgcttacccagtagcatgctctatagacatcaacagcagcagcaacagcaacagcagcaacagcgtatacaataccccagatcctcttttttcgtcggtccggcctcagttttcgatttgaacttgaccaagcatgtaagactagataatgttgaccaaatacagctatcaaaaactttatcattaagaaaggtgtctcctaccgcacagtttattcttcaggacgattttgacacgacccttcatagtaagcaagaatacgaagttgatttggtcgaaaatctggtacatccgcacggtcaccttttagtagagattttcttcaaattgattcatccttttcttccaattttacacgaacgtgtatttttggaaaagtattctagatcttatagagaactcactgcgcctttactggcatccatttactcactggcattacaatattgggattttcatcctgcacttttggggttccctaaacccgatgtaactgctcaactaaacaatatcgcattggaaacattttatgctcgagttggaaggccaaaattgagcattatacaaacaggccttttgattttgcaatgccgtagtgaatgtcataacaactgggtcctctgctccagcgtagtggcccttgcagaggaattggggctcggggttgaatgtaatgattggaaacttcccaaatgggaaaaagatttgagaaagagattagcgtgggcagtttggttgatggataaatggtgtgcattaaacgaaggtagacaatcccatttaattttaggtaggaactggatgatcaagctattaaactttgatgattttcctctgaattcgcccactattttaaattccttgcaaaatgaccagtcggggtcttcaccctcgtcatcaaatgatgtgaaaaaccatcagatagcatttggtaacttgcccatatttaacataaaccccactttagaagatttcaagaatggaacgcttatgtttcaacaaatggtttccttgagtataattcttggggaaatcatggacacattttacactcagggatccatgacaataaacaaaagcattgaacaggtattgaaactggcaaagccgttgcaactgaaattaagagaatggtaccattccctacccaagaatttgtcaatgagttatgccacgccacaaaaattgaactcaaattcaactttaactctagcttattttgccacggaaattacgttacataggaaaattatctgtgccttgaatcctcaaactccaaaggaactggttcaagtatgcaggactgctgcaagaaccaggcttgtagcagcaattgaatttataagagatctaaaaaacgaacatattaatgctttttggtataactgctcaactggaaatctgatgctaattggaacatttgctgccctgctgtatgtgacttcagctacgaaggaagaggctatgattttcagagattatgttagaaattatacctgggtattgaagataggttccaaatactttgataaactatcgaatgctttgaataatatgcatttactatttgcacaaattcctggtcttctgaccgatgaaccggtggtcgtgagccctaactctaacatcaattccgttaacccacaaaggtcaggtgtacaatcgcaaatcccaatacaatttaacgtgggatcacctgccatggccgagcaaggatctcctttaaaccagtggaagaatttgccccaggaaatcttgcaacaactaaactcctttcccaacggtacgaccagtacaacaacgccagtaaaccccacttccagacaaacacaactagaatcgcagggaagtccagccataaatagtgctaataataatagcaacaacacgcctttaccatttgcgccaaataagtcttctaaaaaaacttcacaatcttcaccaaatgttacgccctctcatatgagcagacaccccccctctaatacatcttcaccaagagtcaattccagcacaaatgtcaactctaatacacaaatgaatgcttctcccttgacctcaattaacgaaaccagacaagagtcaggtgacgctgcagatgaaaaaacagcaggaagagaaagaaccgccaacgaggaatcatcaacggaactcaaggacgataatccaaactcgaaccaggaaacaagcgcaactggtaaccaaactataaaaatgaatgatgataaaaatgtaacaattaacacaagggaaacccctctg

SEQ ID NO: 126 - protein, 970 aa, Saccharomyces cerevisiae
MDPHQSPADNAASPTKSVKATTKNSSTNNNVNSNNSNNNSNHDILNFNDNYTTILQHLANDHPNILREKGGSQQQQHQQQQQQQQQQQQQQQQQSLDTLLHHYQSLLSKSDNAIAFDDNVSNSADHNGSNSNNNNNNNDISSPGNLMGSCNQCRLKKTKCNYFPDLGNCLECETSRTKCTFSIAPNYLKRTSSGANNNMPTSSNSKRMKNFEDYSNRLPSSMLYRHQQQQQQQQQQQRIQYPRSSFFVGPASVFDLNLTKHVRLDNVDQIQLSKTLSLRKVSPTAQFILQDDFDTTLHSKQEYEVDLVENLVHPHGHLLVEIFFKLIHPFLPILHERVFLEKYSRSYRELTAPLLASIYSLALQYWDFHPALLGFPKPDVTAQLNNIALETFYARVGRPKLSIIQTGLLILQCRSECHNNWVLCSSVVALAEELGLGVECNDWKLPKWEKDLRKRLAWAVWLMDKWCALNEGRQSHLILGRNWMIKLLNFDDFPLNSPTILNSLQNDQSGSSPSSSNDVKNHQIAFGNLPIFNINPTLEDFKNGTLMFQQMVSLSIILGEIMDTFYTQGSMTINKSIEQVLKLAKPLQLKLREWYHSLPKNLSMSYATPQKLNSNSTLTLAYFATEITLHRKIICALNPQTPKELVQVCRTAARTRLVAAIEFIRDLKNEHINAFWYNCSTGNLMLIGTFAALLYVTSATKEEAMIFRDYVRNYTWVLKIGSKYFDKLSNALNNMHLLFAQIPGLLTDEPVVVSPNSNINSVNPQRSGVQSQIPIQFNVGSPAMAEQGSPLNQWKNLPQEILQQLNSFPNGTTSTTTPVNPTSRQTQLESQGSPAINSANNNSNNTPLPFAPNKSSKKTSQSSPNVTPSHMSRHPPSNTSSPRVNSSTNVNSNTQMNASPLTSINETRQESGDAADEKTAGRERTANEESSTELKDDNPNSNQETSATGNQTIKMNDDKNVTINTRETPL

SEQ ID NO: 127 - DNA, 2442 bp, Saccharomyces cerevisiae
atgacatccgatgatgggaatgctggacaagaaagagagaaggatgctgaactgattgaggttgggggcaagaaagtgagcaagacttcgacagggaaacggaagtttcataacaagtccaagaccggttgcgacaattgtaaaagaagaagagtaaaatgtgatgaaggcaaaccattttgcaagaaatgtacaaacatgaaattggactgtgtttacagccctattcagccaagaagaagaaaagattcttcgtcgtcaaaatttgcatcagcggtccacgatagggtaggcaagaaaaatctgagtgacaatgccatcatgttacaacaacaacaacagcaacttcatcatcaacaagaacagcaatttcgtcaacaacagcaagttcagttacagcagcaactgttgccacatgttggtactgatgaacaaagcaattcccctaatagcgttcctccatccgtatccaataatatggagaatcttttgttaccgcacctattagcgagtttagtgaataacaccagtaacagtaccaacagcagtgcaaatggagctgaagcgcataataatataacacaaacagctcccagttcaatgataaacaacaaccacccaaacatggccctaccagggaattcgccattgagtataccgataacacctagttttcaatcaacggccatgaatttatcaagtagccttaacggcttactctcgcctggtaggctaaattcggtgacgaatggattgcagcagccacaacttcaacaacaaaatcagcaaattccacaacaacaaggaacacagtcccccttcagcaatattcccttcgaccagctagcgcaattgaacaagatgggcttgaacttcaatatgaagagcttcaatacattatttccatacggtgctgcaaatggaatggcctctgagtttcaagagttatttggcctcggaaagtttgctacatctaataacagagcaatcaaagttagcacagcagaggaggcactcgcaaatatgcaacaggaacaggaggacaaaaacaagcaatttacgaagaacccattggataatactaagacggatgctgttaattcgggcaataacccccttaacggaaacgaaaataaagttactgcttctgatatactatctcataacaaaaacttgataatcgacaataccggtctcacaatcagtcccccacacacgttgtccaaaccttccatagatcaaaacattgcgtccccttcaacgggagtatccaatgtaacctctacaaagtcattgttatctataccggacaacaggaccgctttgggaaattctcctactttgaagacgtccccaatgggtgacctgttatccaactcggaggcattgtctccacgttcatcaaattctcacactcaacaacaatcttctccccattcaaacgcttcatcagcctcacgactagtccctgaattagtcgggctgtctagaaaatcaaatttgaatttgatagatctaaaactttttcatcactattgtactgacgtatggcataccataaccgaagcaggcatttctggtcctgaagtatggagcacttatattccggatttggcttttcattttcccttcttgatgcatacaattttggcttttagcgccactcatttgtccagaactgaagccggcttggataactacgtgtctagtcatcgtttagaagcgttgagactgttaagagaggctgtgctcgaaatttcagatgataacacagatgctttggtggctagtgctctaatattaatcctagattcattggcaaatgcttcaagcagctcaccaacggcatggattttccatgttaaaggcgccgtaactatactaactgctgtatggcccctgtcggagacatccaagttttataacttaatttctgttgacttgagtgatttgggtgaagctgtaatcaaccaaagtaatcataataatgataatgacaatagcaataatggtgatggaaataacaataatacgatatcggaactcgtatgctttgacgaaagtatagcagatttatatcccgtagaaattgattcaccgtacttgataactttagcatatttggacaaactgcatcgcgaaaaaaatcaattagattttatgttgagagtcttctcatttcctgctcttttggataggacttttttagcattattaatgacaggcgacctaggggccatgagaataatgaggtcttactatacattattgagaggttataccacagaaataaaggacaaagtgtggttcttggatagcgtatcacaggttttaccacaggatgttgatgagtatagtggaggtggtggtatgcatatgatgctggatttcttaggaggtgggttaccttctatgaccactacaaacttttcagcttttatg

SEQ ID NO: 128 - protein, 814 aa, Saccharomyces cerevisiae
MTSDDGNAGQEREKDAELIEVGGKKVSKTSTGKRKFHNKSKTGCDNCKRRRVKCDEGKPFCKKCTNMKLDCVYSPIQPRRRKDSSSSKFASAVHDRVGKKNLSDNAIMLQQQQQQLHHQQEQQFRQQQQVQLQQQLLPHVGTDEQSNSPNSVPPSVSNNMENLLLPHLLASLVNNTSNSTNSSANGAEAHNNITQTAPSSMINNNHPNMALPGNSPLSIPITPSFQSTAMNLSSSLNGLLSPGRLNSVTNGLQQPQLQQQNQQIPQQQGTQSPFSNIPFDQLAQLNKMGLNFNMKSFNTLFPYGAANGMASEFQELFGLGKFATSNNRAIKVSTAEEALANMQQEQEDKNKQFTKNPLDNTKTDAVNSGNNPLNGNENKVTASDILSHNKNLIIDNTGLTISPPHTLSKPSIDQNIASPSTGVSNVTSTKSLLSIPDNRTALGNSPTLKTSPMGDLLSNSEALSPRSSNSHTQQQSSPHSNASSASRLVPELVGLSRKSNLNLIDLKLFHHYCTDVWHTITEAGISGPEVWSTYIPDLAFHFPFLMHTILAFSATHLSRTEAGLDNYVSSHRLEALRLLREAVLEISDDNTDALVASALILILDSLANASSSSPTAWIFHVKGAVTILTAVWPLSETSKFYNLISVDLSDLGEAVINQSNHNNDNDNSNNGDGNNNNTISELVCFDESIADLYPVEIDSPYLITLAYLDKLHREKNQLDFMLRVFSFPALLDRTFLALLMTGDLGAMRIMRSYYTLLRGYTTEIKDKVWFLDSVSQVLPQDVDEYSGGGGMHMMLDFLGGGLPSMTTTNFSAFM

SEQ ID NO: 129 - DNA, 2601 bp, Aspergillus nidulans
atgccaggaattctccccatgaaagtgatcaaggtcggcaataacacgcagagtcgtattgcccaagcctgtgaccggtgtcgaagcaaaaagatccgctgcgacggtattcgcccatgctgcacacaatgtgccaacgtcggcttcgagtgcaaaaccagcgataaactcagtcgacgagcgtttccccgtggatacacagagtctctggaagaacgagtacggacactagaagctgaggtcagggaacttaagagtctcctggatgagaaggatgagaagattgatgtgctctctcggatacactctttctcctcaccttcacagcagaagactcctgctgctgtgcactctccgactcagcctcccccggctgctccaacgagtgtgcctacccccagtgagggagccgttcatgttccggatccggttgctttgagcagcacagaggagtccggggtttcgaacacccgtggctttgctgctgtcttcaccaacatgcttgcagaccaaggccggctagctccagaaacttccactaaagctttgtctgcttctcctactcctattactccttctcgtctcgaccagcctctgaaaacaacgcctcggcttgtatcggatcagcttatcaacattttctttcaagaatgggcacctctttacccggttgtccaccgacctaccatcctcaaggcatacgagcaatacctttccaattccgaacacattcaaggcaacaaacatgagatggcccagctgaatctgatctttgctgttgctgcactcggcgctatttcgagaaccaaccaggaccctaccctctttgaggagaattggtcttctattcttgagtcgttacatgccgacatttctatcccaaccttgcagtgttacgtgttggcacaaatgtattgcttgaccaagggtgactacacaaatgttctgcgctatcgtggtgtagctgttggcgtctgccaccaattgaaactacagaagagtcagaaggctttctcatcgaacgctcttcttgctgagaccaggaagaaagttttttggtgccaatatgttctggatcgtctttgcgcttctttgactggtcttcctgttcttcttcgcgaagagcacatccagactgagtatcccgaagatatcgatgatgagaacgtgacggaaaccggtttcttgcccaccttgcccggcgagtccacacgtatctccagcgccctcgccctgttttccgcatctagagttctgaacagcacgttggagaatatctacccgtctgacggtgcatacgaaatcccattgtcaaaaatgcgtttcgttacggaacagctcgataaatgggtcaagagcctacccgctcatcttcacttggagttcacacaggataagccgagcaccaacgtcattagcagtcggtctccacttttgtctgtgatgtattatttcattcgttctctcatccaccgtcctgccgtctgctttggtgacgatcacgttcgttcaccttcagtccttgcgattgcggattccggcaagcatatcatccaaattctccaactgcttgacgagaggcgcctatgtctctctcttagcatcaaccgaagagagctcatcagctccgcagggcttgggcttctctggcaaaatgtcggcctgaagcgtgatagcaaacttgtcaaagaaagtcaaaaggtgcttacaggcgttattgatcagcttgagtctgaatcatccgtggctgcgaccgagttcagtgctctagccggtgccctcgtttcattagataccaaacgaccaacgaccaccaaccctcaacaaatgagcccacccgcccaaaaacccttgaagtctccgaggagacagctggaggcatggaaggcccgcttgatcggcagcactagcccgggtcaatctcagccaaaaccggagcctctgtcacgcagaaacaccttttctggttcgagccctggtttagcggagcgccaattacgttctcctagttgggctagcctacctcccaacgacttcccgcaccatgccccgatgagcaagaacgtttacaaccaccctatggggtatgaaggcaatccgtccatgtcctgctcggtaccgacggaccatccagctccaccatcaggaaatctaacggtctcggactgggagttcgtggtgagcgatatggatcaaggctactcgaatatattcacaggaatctatggtggcaaagaatgcggcgaagatcacggcccttttgcgtctttgactgctgagtacatgcacaaacaaggacccggcctgccgccttctttaacttcaagcgatgaattgcaaggcctgtctccggaggcttggtctgccactagcagtagcgatatggctcaacctccagaacttgcagcacagagtgtctattcggacgggagtctgggaagcagagaccacagcttgtcacttccaagtactatgccttttccgatggaggataggccgggtagcctcttggatccacttcaaggcgttattatccctgctggagacgacgatattgaagaatttgggctggtcaacggttgggatcgacggctggccgtc

SEQ ID NO: 130 - protein, 867 aa, Aspergillus nidulans
MPGILPMKVIKVGNNTQSRIAQACDRCRSKKIRCDGIRPCCTQCANVGFECKTSDKLSRRAFPRGYTESLEERVRTLEAEVRELKSLLDEKDEKIDVLSRIHSFSSPSQQKTPAAVHSPTQPPPAAPTSVPTPSEGAVHVPDPVALSSTEESGVSNTRGFAAVFTNMLADQGRLAPETSTKALSASPTPITPSRLDQPLKTTPRLVSDQLINIFFQEWAPLYPVVHRPTILKAYEQYLSNSEHIQGNKHEMAQLNLIFAVAALGAISRTNQDPTLFEENWSSILESLHADISIPTLQCYVLAQMYCLTKGDYTNVLRYRGVAVGVCHQLKLQKSQKAFSSNALLAETRKKVFWCQYVLDRLCASLTGLPVLLREEHIQTEYPEDIDDENVTETGFLPTLPGESTRISSALALFSASRVLNSTLENIYPSDGAYEIPLSKMRFVTEQLDKWVKSLPAHLHLEFTQDKPSTNVISSRSPLLSVMYYFIRSLIHRPAVCFGDDHVRSPSVLAIADSGKHIIQILQLLDERRLCLSLSINRRELISSAGLGLLWQNVGLKRDSKLVKESQKVLTGVIDQLESESSVAATEFSALAGALVSLDTKRPTTTNPQQMSPPAQKPLKSPRRQLEAWKARLIGSTSPGQSQPKPEPLSRRNTFSGSSPGLAERQLRSPSWASLPPNDFPHHAPMSKNVYNHPMGYEGNPSMSCSVPTDHPAPPSGNLTVSDWEFVVSDMDQGYSNIFTGIYGGKECGEDHGPFASLTAEYMHKQGPGLPPSLTSSDELQGLSPEAWSATSSSDMAQPPELAAQSVYSDGSLGSRDHSLSLPSTMPFPMEDRPGSLLDPLQGVIIPAGDDDIEEFGLVNGWDRRLAV

SEQ ID NO: 131 - DNA, 2586 bp, Aspergillus niger
atgcctggaattctcccgatgaaagtgatcaaggtcgggaacggctcgcagagtcgtatagttttagcctgtgatcgttgcagaagcaagaagatccgttgcgacggcgtccgtccctgttgtacacaatgcgccaatgtcggcttcgaatgcaaaaccagcgacaagctcagtcgccgtgctttaccccgtggatataccgagtcgctggaggaaagagtgcgcgccctggagtccgaagttagggatctcaagaacttactggacgaaaaggatgaaaagatagatgtgctctctcgcattcattctttctccccttcctcgcgtcagagacctagtgttgcagcgccgtcgccatctgcgcctgcaaggtccaacgcccccgatgtagacgagggcgtaattcaaatcccaccatcgttgccgcctaccgagtcgacctcggctgagagtacaggaatatccagtacttgtggctttgttgatatcttcacaaatagactcatagagcaaaaccgattaccatccaatgtcgcgatcaagtctttggctactcccccggccatctcccattcccgtgtcgaccaggctattcgcacggcgcctcggctcgtatccgatcagctcatcaacatcttcttccaagaatgggctcctctctatccggttgttcaccgacccactatcctcaaagcttatgagaagtaccttcaggcaccgagtctatgcaggcagaagcacgacttggcacaactgaatttaatcctcggaattgccgctcttgcttcaatgtcgagaaccaatcaggaccccacctttttcgaagacaattggtcttcgatcctcgaatcaatcgcaagtgacatttctattacaacaatgcaatgctacgtgctcgctcaaatgtactgcatgacgaagggcgattacacaagcctcctacgctatcggggtcttgctgtcagtctgagccaacagcttagactccaccagagccagaaacgcttctcgtcgaatgcgcttgtggccgaaacccgaaagaaggtgttctggtgccaatatactctcgatcgatttaccgccgctttgacgggattgcctgtcctgctgcgtgaagaggatatcaagactgagtatcctgacgatatcgacgatgaaaatcttacggaaacgggcttcttgcccactctccctggcgagtctacccggctctcgagtgcgatcgcgctattcgccggttcgcgggtgttgaacaaggttttggaggaaatctatccctctgacggagggtatgatattcctctgtcgaagctacggtcggctgcagagcaattggatgagtgggtgaagggcttgcctgctcacctccgccttgagttctctcaagacaagcctagcaccaatgttaccagtagccggtcgccacttctgtccctcgtctattacttcattcgttcattgatccaccgccctgcggtctgcttcggcgaggagcacgtccgatcgccttctatccttacagtttccgactcagcaaagcatattgtccagattcttcaattgctcgatgagagacgtctctgcctctctgtgagtatcaatcggaaggagctggttttcgccacaggactgggcctcctttggcaaagcatcggtctgaagcgtgacagcaaactcgtcaaggagagagctcaaaagttgctcaccgcagtcatcgatcaactagagtctgagtcgtcatcctctgccgccgagttcagcgctttggccagtgtttttgtttccttgaataataagcacgtggcgattggtaaaccgcaggacatgtcgccgcccttgcagagacctctgaagtccccgaagaagcagctgcagtcgtggaaaccgcgcttgagtggaatgaccggctcaagccaccacgaaacgccagattcgccatctcggagggccacaatttgcgaaacgagtcctaatgccgctcaacgccacatcaggtcttccagctgggctagcttgccaccggacaacttccacgcgctagatcgtgtctacgaacaagacagctatccttcgtcttccggctcgtacgatagcagtcatgtgctttcgagctccgcaccctcggatcacccgggcggaccgatcacggtatccgactgggaagtagtcctgagtgacatggaccgcggctattcgaacatcttcaccgggatctacggaggaagggagtgtggtgaggacagcggtcccttcgcttccctcactgccgagttcgcccacaagggggatcccatggtagcaccgttatcagcgccacaagccgagctgcaagggttgtctcccgaggcatggtcagaagtagcaatagcgacgtgccagccaatcaggacctcccggcacagagtgtcctacgctactctgatgaaggacgtgcggaagacggagtgccatacaacgacatggctgtcgccggaagagacggccaatttcttgggttcgttccggaatgtcatgatcccagcggtggaagacgaagtggaagatgaatttgggctgattaacggctgggatcgacgactggctgtc

SEQ ID NO: 132 - protein, 862 aa, Aspergillus niger
MPGILPMKVIKVGNGSQSRIVLACDRCRSKKIRCDGVRPCCTQCANVGFECKTSDKLSRRALPRGYTESLEERVRALESEVRDLKNLLDEKDEKIDVLSRIHSFSPSSRQRPSVAAPSPSAPARSNAPDVDEGVIQIPPSLPPTESTSAESTGISSTCGFVDIFTNRLIEQNRLPSNVAIKSLATPPAISHSRVDQAIRTAPRLVSDQLINIFFQEWAPLYPVVHRPTILKAYEKYLQAPSLCRQKHDLAQLNLILGIAALASMSRTNQDPTFFEDNWSSILESIASDISITTMQCYVLAQMYCMTKGDYTSLLRYRGLAVSLSQQLRLHQSQKRFSSNALVAETRKKVFWCQYTLDRFTAALTGLPVLLREEDIKTEYPDDIDDENLTETGFLPTLPGESTRLSSAIALFAGSRVLNKVLEEIYPSDGGYDIPLSKLRSAAEQLDEWVKGLPAHLRLEFSQDKPSTNVTSSRSPLLSLVYYFIRSLIHRPAVCFGEEHVRSPSILTVSDSAKHIVQILQLLDERRLCLSVSINRKELVFATGLGLLWQSIGLKRDSKLVKERAQKLLTAVIDQLESESSSSAAEFSALASVFVSLNNKHVAIGKPQDMSPPLQRPLKSPKKQLQSWKPRLSGMTGSSHHETPDSPSRRATICETSPNAAQRHIRSSSWASLPPDNFHALDRVYEQDSYPSSSGSYDSSHVLSSSAPSDHPGGPITVSDWEVVLSDMDRGYSNIFTGIYGGRECGEDSGPFASLTAEFAHKGDPMVAPLSAPQAELQGLSPEAWSEVAIATCQPIRTSRHRVSYATLMKDVRKTECHTTTWLSPEETANFLGSFRNVMIPAVEDEVEDEFGLINGWDRRLAV

SEQ ID NO: 133 - DNA, 2577 bp, Aspergillus oryzae
atgcctggaattctcccgatgaaagtgatcaaggtcggcaacggcgcccaaagtcgtatcgcccaggcctgtgatcgatgcagaagcaagaagattcgctgtgatggaatccgtccatgctgtacgcaatgcgccaacgttggtttcgaatgcaaaacgagcgataagctcagtcgccgcgcttttccccgtgggtacaccgaatcgttagaagaacgagtgcgagcgttggaggcggaagtgagggacttgaagaacttattagacgaaaaggatgagaagatcgacgtactatctcggatacattctttttctccctcttcacagcacagggcggctgcctccgcacggtcgtcgtctgaatcggtcaagtcgagcgcacccgacacgaacgaaggtgtcattcaggtccaggaaccggtattggtaggcgaattatctgatgtcgaaactggaattgcaagtattcgcatcttcacgactaggctcatggatcagggccgattgccaccgaatgtctcaactaaggctttgacagcatcacctaccccaattgctgcctctcgtacggaccaggtcatcaagaccgcaccgcgacttgtgtctgatcaactaattaatatcttcttccaagagtgggctcctctttaccctgttgttcacaggcccaccatccttaaagcctacgagcagtacctgtcgaatacagaaacgttgcaaggcagtaagcatgacatggcccagttgaacttgatatttggcattgctgctcttgcgtcaactacgagaaccaaccaggacccaacattttttgaggataactggtcgccggtccttgaatcgctctcaggcgatgtgtccgtctcaactttgcaatgctatgttttggctcagatgtactgtatgaccaagggcgattataccggccttttacgctaccgtggctctgccgtcagtctttgccatcagttgagacttcaccagagtcagagacgcttttctgccaacgctctggttgctgagacgcggaaaaaagtgttttggtgccaatatgtggtcgatcgcttcactgctgctttaactggattgcctgttctactccgcgaggaagatattcatacggaatatccggaggatattgatgatgagaatgtcaccgaaacaggtttcctgcctactctccctggcgagtccactcgcatctctagcgcgatcgcgttgtttgcggcctgcagggtcttgaacaaggctttggaagatctatatccctctgatggagggtacgaaattcctatctcgaaattgcgttcggttgctggacagctagacggttgggtgaagaacttacctcctcacctccgtctagagttttcgcaggataagcctagtacgaatgttacaagtagccggtcgccacttttgtctctcgtttactacttcatccgttcattaattcatcgcccggctgtctgctttggcgaagaacagatccgttcgccgtcttcgctcgccgtctctgattgtagcaagcgcatcgttcaaatcctccaacttctcgacgagaggcgcctttgcctttcgatcagcatcaaccgaagagagttggttttctcttccggtctcgggcttctgtggcagagtatcggcctcaaacgagacagcaagcttatcaaagaaagccagaagctgcttactgcgatcattgatcagttggaatcagagtccccagctgctgccgcagaattcagtaccttggctagcgcgctagtctcacttgatggtggcaaacgtgcaacgtccgataagccccgtgaaatgtccccccctgagcagaagccgtcgaggtctcctaaaaagcaactgcaagccttgaagtcccgcttggctgctagcgccggcttcggtcagcctgcaaagcaagactcgccgtcacgcaggaatactatctccggcgccagccctcatattgcccagcgtcagatacggtcttctagttgggccagccttcctacccccgagaacctgcgcttgcctggagaaaagatgtactacccgtctcatcctttgggatacgatcaaggtcatatgctttccagctctgtaccctcagacgtcgcccacggagctatcacgatgtccgactgggagttcgttctgagcgatatggaccgaggttattctaacattttcaccggaatttatggtggcaaggaatgtggtgatgacgctggacctttcgcatccctgacggccgaatacgcacctaagcccgactctatgacagcaccgatgccggtatcccacaatgacctccagggactgtcccctgaagcttggtcttctagcagcaatagcgatgtggccccgactcgggagatggcggcacagagcgtcctgagttactcggatgagagcatgggcagtacggaagaggcggtaccctacaacgacctccggctgtccccggaagagcaagccaatctactggatcccttccaaggcgtcgtgattcccgccgcggaggacgaggtcactgagtatggacttatgaacgggtgggatcggcggctggccgtc

SEQ ID NO: 134 - protein, 859 aa, Aspergillus oryzae
MPGILPMKVIKVGNGAQSRIAQACDRCRSKKIRCDGIRPCCTQCANVGFECKTSDKLSRRAFPRGYTESLEERVRALEAEVRDLKNLLDEKDEKIDVLSRIHSFSPSSQHRAAASARSSSESVKSSAPDTNEGVIQVQEPVLVGELSDVETGIASIRIFTTRLMDQGRLPPNVSTKALTASPTPIAASRTDQVIKTAPRLVSDQLINIFFQEWAPLYPVVHRPTILKAYEQYLSNTETLQGSKHDMAQLNLIFGIAALASTTRTNQDPTFFEDNWSPVLESLSGDVSVSTLQCYVLAQMYCMTKGDYTGLLRYRGSAVSLCHQLRLHQSQRRFSANALVAETRKKVFWCQYVVDRFTAALTGLPVLLREEDIHTEYPEDIDDENVTETGFLPTLPGESTRISSAIALFAACRVLNKALEDLYPSDGGYEIPISKLRSVAGQLDGWVKNLPPHLRLEFSQDKPSTNVTSSRSPLLSLVYYFIRSLIHRPAVCFGEEQIRSPSSLAVSDCSKRIVQILQLLDERRLCLSISINRRELVFSSGLGLLWQSIGLKRDSKLIKESQKLLTAIIDQLESESPAAAAEFSTLASALVSLDGGKRATSDKPREMSPPEQKPSRSPKKQLQALKSRLAASAGFGQPAKQDSPSRRNTISGASPHIAQRQIRSSSWASLPTPENLRLPGEKMYYPSHPLGYDQGHMLSSSVPSDVAHGAITMSDWEFVLSDMDRGYSNIFTGIYGGKECGDDAGPFASLTAEYAPKPDSMTAPMPVSHNDLQGLSPEAWSSSSNSDVAPTREMAAQSVLSYSDESMGSTEEAVPYNDLRLSPEEQANLLDPFQGVVIPAAEDEVTEYGLMNGWDRRLAV

SEQ ID NO: 135 - DNA, 2376 bp, Neurospora crassa
atgccaagacaacacctaacaccgaacgcgtgcctagtatgccgcaagaaaaggacaaagtgtgatggccagatgccatgccgcaggtgcaggtctcgtggagaggaatgcgcatacgaggacaagaaatggcgtaccaaggaccatctcaggtccgaaattgaaagacttcgaaacgagcaacggcagggacatgcggtgattcgggctctcatcaacgacgagcaggactgggagtcgttcctatcacggatccggggcgatgaatcaccagaggctattgccgactggatacgctcgatacggaacctttttgagccgctccaggcggcgtcatcacagagcatgggaggcttgggtgcaccaccaacattgctgtcaccgtctcaagccaccgcttccgagtcatcacaactgcacagagccgctagcttcgctggcattggcagctacaactttggtcagggccgggtcccatttgaccagtccactcctcggagcagcttctcctcggatctctcccctaccacccccttctcgttcagggaacaagcagatttcattcacgcccctcagcccatgtatccgtcctctagaaggttttctagctcatcccttccatcccttcctctgcgacattcttcgcaacctcttgtgcctggtatcttcaacgagcccttgcctcatacttggaccagtataacatcagacacccagctcgtccagagacttctatccagattcttctcggctccatgctctttactatgcttcatcccgcaatcttctttcatgaaggcgtttcgtgagggcgattcccgctactgttccgaggccctggtgaacgccattttgggaaaggcctgcaaatcttacggtacggcctcaaatattgtgtccagaatggcatttggagatgcattcattggcgaagcaaagaggctgctagcaaccgaaccgaaccacacgaaccttccgagcacccaagctttggctgtccttgcccttgctgagatctctgaaggaaaagacgatgaagcctgggacttggcatgggcatccgtgagggcagcgataactcgtgaacagagctttcatgtggatcaagaattcgcaacagccagggcagtgtcttattgcggtggtttcacgttgattcacatgctacgccttcttaccggtcgtctcgacctgaacactagtccctttttcatgaggctatatcagggttctgaagagactcctgaagatgagccacaaaatcgcattgaacgaggattcgcgctgcatatgcagttcctagctgaactagaacactgcccgccgcttcctcggtttgtgtttgaaatcacaaccgctgtgcacacttttgcgtcgtacaatttctccaacgccgcaactgccgaagagcttgaagacgcttatggaaagtgtctggatgcctacaagcgttttgaagaaacattttgccttgatatggataccacgccggacttgttgtttgcacagatctggtatcactattgcctgctcgctcttctacgccccttcgtaaagagcaccgcaagcttgagagacagtgcaatgacaacccccagactacgaaacgatgccaacccttccgatatttgccaacgatcatctgaggccatcatctttctcacgagtacttaccaaactcgcttctcgttgggcaacccgcctgagctgctcccccatatgctctttgcggccgttctctatcaggtgacgctcacgcccgaccccgagcacttgagcaccattgccaacgacattaaaccggagctttccgaatcccctgtgatgatgccgtctcaggctgcctttggtgctcatgggaactccaatttggttccgccgccgccgatgccgttcaacaaccatggttcttatttcccgcaacctctttctcccgtgttgaagttggaagtcagacaggcagcaccccgtcgcgagtccagcatctcgttgtcatctacctttgacagctgtggcaatcgccgacccagcgacagtttcacatccagcacactgacttctcatgatgcttcggagagagagtcctccacgtcagacactcagtccgatttcctcccgtttttcacctcggagcctgctgaccttgtcaccatcggttcactgcaactagcatccatgcaacatcacggtgccgtcgaagcgactcgcttattgcgtagtttgagcaccgtgaaggatctagtgggatccactcttgacctggaaactttggccgaggcattgcccttccccatgggtgatctcaacacagccgtactctatacgggccttggtctgcagagggcgcctgttgagccaatgcaggtcactgggccg

SEQ ID NO: 136 - protein, 792 aa, Neurospora crassa
MPRQHLTPNACLVCRKKRTKCDGQMPCRRCRSRGEECAYEDKKWRTKDHLRSEIERLRNEQRQGHAVIRALINDEQDWESFLSRIRGDESPEAIADWIRSIRNLFEPLQAASSQSMGGLGAPPTLLSPSQATASESSQLHRAASFAGIGSYNFGQGRVPFDQSTPRSSFSSDLSPTTPFSFREQADFIHAPQPMYPSSRRFSSSSLPSLPLRHSSQPLVPGIFNEPLPHTWTSITSDTQLVQRLLSRFFSAPCSLLCFIPQSSFMKAFREGDSRYCSEALVNAILGKACKSYGTASNIVSRMAFGDAFIGEAKRLLATEPNHTNLPSTQALAVLALAEISEGKDDEAWDLAWASVRAAITREQSFHVDQEFATARAVSYCGGFTLIHMLRLLTGRLDLNTSPFFMRLYQGSEETPEDEPQNRIERGFALHMQFLAELEHCPPLPRFVFEITTAVHTFASYNFSNAATAEELEDAYGKCLDAYKRFEETFCLDMDTTPDLLFAQIWYHYCLLALLRPFVKSTASLRDSAMTTPRLRNDANPSDICQRSSEAIIFLTSTYQTRFSLGNPPELLPHMLFAAVLYQVTLTPDPEHLSTIANDIKPELSESPVMMPSQAAFGAHGNSNLVPPPPMPFNNHGSYFPQPLSPVLKLEVRQAAPRRESSISLSSTFDSCGNRRPSDSFTSSTLTSHDASERESSTSDTQSDFLPFFTSEPADLVTIGSLQLASMQHHGAVEATRLLRSLSTVKDLVGSTLDLETLAEALPFPMGDLNTAVLYTGLGLQRAPVEPMQVTGP

SEQ ID NO: 137 - DNA, 2643 bp, Saccharomyces cerevisiae
atgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattatttgtacaagataatgtgaataaagatgccgtcacagatagattggcttcagtggagactgatatgcctctaacattgagacagcatagaataagtgcgacatcatcatcggaagagagtagtaacaaaggtcaaagacagttgactgtatcgattgactcggcagctcatcatgataactccacaattccgttggattttatgcccagggatgctcttcatggatttgattggtctgaagaggatgacatgtcggatggcttgcccttcctgaaaacggaccccaacaataatgggttctttggcgacggttctctcttatgtattcttcgatctattggctttaaaccggaaaattacacgaactctaacgttaacaggctcccgaccatgattacggatagatacacgttggcttctagatccacaacatcccgtttacttcaaagttatctcaataattttcacccctactgccctatcgtgcactcaccgacgctaatgatgttgtataataaccagattgaaatcgcgtcgaaggatcaatggcaaatcctttttaactgcatattagccattggagcctggtgtatagagggggaatctactgatatagatgttttttactatcaaaatgctaaatctcatttgacgagcaaggtcttcgagtcaggttccataattttggtgacagccctacatcttctgtcgcgatatacacagtggaggcagaaaacaaatactagctataattttcacagcttttccataagaatggccatatcattgggcttgaatagggacctcccctcgtccttcagtgatagcagcattctggaacaaagacgccgaatttggtggtctgtctactcttgggagatccaattgtccctgctttatggtcgatccatccagctttctcagaatacaatctccttcccttcttctgtcgacgatgtgcagcgtaccacaacaggtcccaccatatatcatggcatcattgaaacagcaaggctcttacaagttttcacaaaaatctatgaactagacaaaacagtaactgcagaaaaaagtcctatatgtgcaaaaaaatgcttgatgatttgtaatgagattgaggaggtttcgagacaggcaccaaagtttttacaaatggatatttccaccaccgctctaaccaatttgttgaaggaacacccttggctatcctttacaagattcgaactgaagtggaaacagttgtctcttatcatttatgtattaagagattttttcactaattttacccagaaaaagtcacaactagaacaggatcaaaatgatcatcaaagttatgaagttaaacgatgctccatcatgttaagcgatgcagcacaaagaactgttatgtctgtaagtagctatatggacaatcataatgtcaccccatattttgcctggaattgttcttattacttgttcaatgcagtcctagtacccataaagactctactctcaaactcaaaatcgaatgctgagaataacgagaccgcacaattattacaacaaattaacactgttctgatgctattaaaaaaactggccacttttaaaatccagacttgtgaaaaatacattcaagtactggaagaggtatgtgcgccgtttctgttatcacagtgtgcaatcccattaccgcatatcagttataacaatagtaatggtagcgccattaaaaatattgtcggttctgcaactatcgcccaataccctactcttccggaggaaaatgtcaacaatatcagtgttaaatatgtttctcctggctcagtagggccttcacctgtgccattgaaatcaggagcaagtttcagtgatctagtcaagctgttatctaaccgtccaccctctcgtaactctccagtgacaataccaagaagcacaccttcgcatcgctcagtcacgccttttctagggcaacagcaacagctgcaatcattagtgccactgaccccgtctgctttgtttggtggcgccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagag

SEQ ID NO: 138 - protein, 881 aa, Saccharomyces cerevisiae
MKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSIDSAAHHDNSTIPLDFMPRDALHGFDWSEEDDMSDGLPFLKTDPNNNGFFGDGSLLCILRSIGFKPENYTNSNVNRLPTMITDRYTLASRSTTSRLLQSYLNNFHPYCPIVHSPTLMMLYNNQIEIASKDQWQILFNCILAIGAWCIEGESTDIDVFYYQNAKSHLTSKVFESGSIILVTALHLLSRYTQWRQKTNTSYNFHSFSIRMAISLGLNRDLPSSFSDSSILEQRRRIWWSVYSWEIQLSLLYGRSIQLSQNTISFPSSVDDVQRTTTGPTIYHGIIETARLLQVFTKIYELDKTVTAEKSPICAKKCLMICNEIEEVSRQAPKFLQMDISTTALTNLLKEHPWLSFTRFELKWKQLSLIIYVLRDFFTNFTQKKSQLEQDQNDHQSYEVKRCSIMLSDAAQRTVMSVSSYMDNHNVTPYFAWNCSYYLFNAVLVPIKTLLSNSKSNAENNETAQLLQQINTVLMLLKKLATFKIQTCEKYIQVLEEVCAPFLLSQCAIPLPHISYNNSNGSAIKNIVGSATIAQYPTLPEENVNNISVKYVSPGSVGPSPVPLKSGASFSDLVKLLSNRPPSRNSPVTIPRSTPSHRSVTPFLGQQQQLQSLVPLTPSALFGGANFNQSGNIADSSLSFTFTNSSNGPNLITTQTNSQALSQPIASSNVHDNFMNNEITASKIDDGNNSKPLSPGWTDQTAYNAFGITTGMFNTTTMDDVYNYLFDDEDTPPNPKKE

SEQ ID NO: 139 - DNA, 3090 bp, Saccharomyces cerevisiae
atggaaaatcaaggtggagattacagcccaaatgggttttcaaactcagcaagcaatatgaatgcggtttttaacaatgaaatcaccggtagaagtgacatttcaaatgtaaaccatcaaactggtaccccacgtctggttcctgaaactcaaatatggtcgatgcctgtgccagatcaactgatgacgatgcctaacagagaaaacacccttatgacaggtagtacaataggtccaaatatccccatgaatgtggcttatcccaatacaatatactcgccaacagagcatcagtcgcaatttcagacacaacagaaccgtgacatcagcacgatgatggaacacactaacagtaatgatatgagcggctctggtaaaaatctcaagaaacgtgtatcaaaggcctgtgaccattgccgaaaaagaaaaatcagatgtgatgaagtggaccagcagaccaaaaaatgttcaaactgtattaagtttcagttgccttgcactttcaaacatcgtgatgagattcttaagaagaaaagaaaattagaaatcaaacatcatgcaacaccaggggaatcacttcaaacctcaaatagtattagcaatcctgtagcgtcttcttcagtaccgaacagtggaaggtttgaacttttaaacggtaattcccccttagaaagcaatatcatcgataaagtctccaatattcaaaataatcttaacaaaaaaatgaattcaaagattgaaaaattggatagaaaaatgtcttacattattgacagtgtggctagacttgagtggttattggacaaggctgttaaaaagcaggaaggcaaatacaaggaaaagaacaatttgcccaaaccagcgagaaaaatatactctacggcacttttaactgctcaaaaactctattggttcaaacaaagtttaggagtgaaagcgtccaatgaggagtttctttctccaatcagcgaaatattaagcatatctttaaaatggtatgcaactcaaatgaaaaaatttatggatttgtcatctccggctttcttctccagcgaaataatattatactcattacctccgaaaaagcaagcaaagagacttcttgagaattttcatgctaccttattatcctctgtaactggtataatatcgttaaaagaatgtctagacttagcagaaaagtactacagcgaaagcggcgaaaaactcacatatcctgaacatttattattaaacgtgtgtctctgctcgggtgcatctgccactcaatcaattataagaggtgattcaaagtttctaaggaaagatagatatgatccaacctcccaagagttaaaaaaaatcgaaaacgttgccttactaaatgccatgtattattatcataagctgtccaccatctgttcaggtacaagaacactacaagctttattactactgaaccgatattttcaacttacctacgatactgaactagcaaattgtattttaggaaccgcgattagattggcggttgacatggaattaaatagaaaatcctcttacaagtcactagactttgaagaagccataaggagaagaagaatgtggtggcattgtttttgtacagataaactatattctttaatgttatccagaccccctattgtgggggaacgcgatatggatatgctaacagatcaaaattattatgaagtgataaaaactaatattctacctgatcttattgataaaaaggaagatctcgataaaattactgatgtcaactctgcattgaatgtagttgtaaatttttgtcagcacatatcccttttcatatcatattatgtttcaaaattggttagtattgagagtaaaatatactctacttgttttgctgtcagaagtactctagatctttcattcgatgccatgcttgataaaatcaaagatctcaatgattctttgaacaattggagagacaacttgcacgtaagtatgaaactaaaaagttataaacagtatttatcggtactttacgctcaaaaatcccaagaaaatccggctttaagttttgagattgcatgctctcgtgttttgaattgtcattttagggcgctatattctaaagtgattttgagcatgatgactacatccttattgattgataacgaacgcctatacaaaggttctcgccatgatattcctcagctattcattcttttttcaagtcaatacttaaacgccagtaaagaaatgttacagctgtttcaaggcatcaattaccaggcgcatatgtataacgaggttatgtatcagttctctactgctatgtttgttctcttcttttacgttgtggataatatgaacgatctaaaaaagaaaggtgaggtaaaagagatcatcgatatcctaaaaaaatcttatgatcgattagtgggagaaaatgatgagcagttactgtttgacaatgtcaaatggaacactttgattgtgttctacagccactttttgaaatacgttttgcaacgttatcatgctttgaacgattctacgtcaatatttgattctaaaccttatgatgaaacgataacgaaagttattatgcattcaagaaagataaaagatgaaacagtcgatcaactaattatgagtctaaaatcatatggttctctccattctttacaaaagggcaacgaagccgatctcgccgatgatggactgaatacgaatgatatttcttcagaagactttgcggaggaagcaccaataaacttatttggagagttatcagtcgaaattttaaaactattaaaatctcactcccccatctcaaattttggagacctatcgccatcttcaaataggaaaggaatatctgatgactcatctttgtacccaattcgttcggacctaacatctcttgtttatcccatccatagttctgataccggagatactctttccagtggtctagagacccctgaaaattctaattttaatagtgacagtggaataaaggaagatttcgaagcttttagagccttattgcctttaggaaaattgatctatgacagagattattctttcgtgaacacttttagggattatgaa

SEQ ID NO: 140 - protein, 1030 aa, Saccharomyces cerevisiae
MENQGGDYSPNGFSNSASNMNAVFNNEITGRSDISNVNHQTGTPRLVPETQIWSMPVPDQLMTMPNRENTLMTGSTIGPNIPMNVAYPNTIYSPTEHQSQFQTQQNRDISTMMEHTNSNDMSGSGKNLKKRVSKACDHCRKRKIRCDEVDQQTKKCSNCIKFQLPCTFKHRDEILKKKRKLEIKHHATPGESLQTSNSISNPVASSSVPNSGRFELLNGNSPLESNIIDKVSNIQNNLNKKMNSKIEKLDRKMSYIIDSVARLEWLLDKAVKKQEGKYKEKNNLPKPARKIYSTALLTAQKLYWFKQSLGVKASNEEFLSPISEILSISLKWYATQMKKFMDLSSPAFFSSEIILYSLPPKKQAKRLLENFHATLLSSVTGIISLKECLDLAEKYYSESGEKLTYPEHLLLNVCLCSGASATQSIIRGDSKFLRKDRYDPTSQELKKIENVALLNAMYYYHKLSTICSGTRTLQALLLLNRYFQLTYDTELANCILGTAIRLAVDMELNRKSSYKSLDFEEAIRRRRMWWHCFCTDKLYSLMLSRPPIVGERDMDMLTDQNYYEVIKTNILPDLIDKKEDLDKITDVNSALNVVVNFCQHISLFISYYVSKLVSIESKIYSTCFAVRSTLDLSFDAMLDKIKDLNDSLNNWRDNLHVSMKLKSYKQYLSVLYAQKSQENPALSFEIACSRVLNCHFRALYSKVILSMMTTSLLIDNERLYKGSRHDIPQLFILFSSQYLNASKEMLQLFQGINYQAHMYNEVMYQFSTAMFVLFFYVVDNMNDLKKKGEVKEIIDILKKSYDRLVGENDEQLLFDNVKWNTLIVFYSHFLKYVLQRYHALNDSTSIFDSKPYDETITKVIMHSRKIKDETVDQLIMSLKSYGSLHSLQKGNEADLADDGLNTNDISSEDFAEEAPINLFGELSVEILKLLKSHSPISNFGDLSPSSNRKGISDDSSLYPIRSDLTSLVYPIHSSDTGDTLSSGLETPENSNFNSDSGIKEDFEAFRALLPLGKLIYDRDYSFVNTFRDYE

SEQ ID NO: 141 - DNA, 4449 bp, Saccharomyces cerevisiae
atgtcgaataccccttataattcatctgtgccttccattgcatccatgacccagtcttcggtctcaagaagtcctaacatgcatacagcaactacgcccggtgccaacaccagctctaactctccacccttgcacatgtcttcagattcgtccaagatcaagaggaagcgtaacagaattccgctcaggtgcaccatttgtcggaaaaggaaagtcaaatgtgacaaactcagaccacactgccagcagtgcactaaaactggggtagcccatctctgccactacatggaacagacctgggcagaagaggcagagaaagaattgctgaaggacaacgaattaaagaagcttagggagcgcgtaaaatctttagaaaagactctttctaaggtgcactcttctccttcgtctaactccttgaaaagttacaacactcccgagagcagcaacctgtttatgggtagcgatgaacacaccacccttgttaatgcaaatacaggctctgcttcctctgcctcgcatatgcatcagcaacaacagcaacagcagcaacaggaacaacaacaagacttttccagaagtgcgaacgccaacgcgaattcctcgtccctttctatctcaaataaatatgacaacgatgagctggacttaactaaggactttgatcttttgcatatcaaaagtaacggaaccatccacttaggtgccacccactggttgtctatcatgaaaggtgacccgtacctaaaacttttgtggggtcatatcttcgctatgagggaaaagttaaatgaatggtactaccaaaaaaattcgtactctaagctgaagtcaagcaaatgtcccatcaatcacgcgcaagcgccgccttctgccgctgccgccgctaccagaaaatgtcctgttgatcactccgcgttttcgtctggcatggtggccccaaaggaggagactcctcttcctaggaaatgtccagttgaccacaccatgttctcttcgggaatgattcctcccagagaggacacttcgtcccagaagaggtgtcccgttgaccacaccatgtattccgcaggaatgatgccgcccaaggacgagacaccttccccattttccactaaagctatgatagaccataacaagcatacaatgaatccgcctcagtcaaaatgtcctgtggaccatagaaactatatgaaggattatccctctgacatggcaaattcttcttcgaacccggcaagtcgttgccccattgaccattcaagcatgaaaaatacagcggccttaccagcttcaacgcacaataccatcccacaccaccaaccacagtccggatctcatgctcgttcgcatcccgcacaaagcaggaaacatgattcctacatgacagaatctgaagtcctcgcaacactttgtgagatgttgccaccaaagcgcgtcatcgcattattcatcgagaaattcttcaaacatttataccctgccattccaatcttagatgaacagaatttcaaaaatcacgtgaatcaaatgctttcgttgtcttcgatgaatcccacagttaacaactttggtatgagcatgccatcttcatctacactagagaaccaacccataacacaaatcaatcttccaaaactttccgattcttgtaacttaggtattctgataataatcttgagattgacatggctatccataccttctaattcctgcgaagtcgacctgggagaagaaagtggctcatttttagtgcccaacgaatctagcaatatgtctgcatctgcattgacctcgatggctaaagaagaatcacttctgctaaagcatgagacaccggtcgaggcactggagctatgtcaaaaatacttgattaaattcgatgaactttctagtatttccaataacaacgttaatttaaccacggtgcagtttgccattttttacaacttctatatgaaaagtgcctctaatgatttgactaccttgacaaataccaacaacactggcatggccaatcctggtcacgattccgagtctcaccagatcctattgtccaatattactcaaatggcctttagttgtgggttacacagagaccctgataattttcctcaattaaacgctaccattccagcaaccagccaggacgtgtctaacaacgggagcaaaaaggcaaaccctagcaccaatccaactttgaataacaacatgtctgctgccactaccaacagcagtagcagatctggcagtgctgattcaagaagtggttctaaccctgtgaacaagaaggaaaatcaggttagtatcgaaagatttaaacacacttggaggaaaatttggtattacattgttagcatggatgttaaccaatctctttccctggggagccctcgactactaagaaatctgagggatttcagcgatacaaagctaccaagtgcgtcaaggattgattatgttcgcgatatcaaagagttaatcattgtgaagaattttactctttttttccaaattgatttgtgtattattgctgtattaaatcacattttgaatgtttctttagcaagaagcgtgagaaaatttgaactggattcattgattaatttattgaaaaatctgacctatggtactgagaatgtcaatgatgtagtgagctccttgatcaacaaagggttattaccaacttcggaaggtggttctgtagattcaaataatgatgaaatttacggtctaccgaaactacccgatattctaaaccatggtcaacataaccaaaacttgtatgctgatggaagaaatacttctagtagtgatatagataagaaattggaccttcctcacgaatctacaacgagagctctattcttttccaagcatatgacaattagaatgttgctgtacttattgaactacattttgtttactcattatgaaccaatgggcagtgaagatcctggtactaatatcctagctaaggagtacgctcaagaggcattaaattttgccatggatggctacagaaactgcatgattttcttcaacaatatcagaaacaccaattcactattcgattacatgaatgttatcttgtcttacccttgtttggacattggacatcgttctttacaatttatcgtttgtttgatcctgagagctaaatgtggcccattgactggtatgcgtgaatcatcgatcattactaatggtacatcaagtggatttaatagttcggtagaagatgaggacgtcaaagttaaacaagaatcttctgatgaattgaaaaaagacgatttcatgaaagatgtaaatttggattcaggcgattcattagcagagattctaatgtcaagaatgctgctatttcaaaaactaacaaaacaactatcaaagaagtacaactacgctattcgtatgaacaaatccactggattctttgtctctttactagatacaccttcaaagaaatcagactcgaaatcgggtggtagttcattcatgttgggtaattggaaacatccaaaggtttcaaacatgagcggatttcttgctggtgacaaagaccaattacagaaatgccccgtgtaccaagatgcgctggggtttgttagtccaaccggtgctaatgaaggttctgctccgatgcaaggcatgtccttacagggctctactgctaggatgggagggacccagttgccaccaattagatcatacaaacctatcacgtacacaagtagtaatctacgtcgtatgaatgaaacgggtgaggcagaagctaagagaagaagatttaatgatggctatattgataataatagtaacaacgatatacctagaggaatcagcccaaaaccttcaaatgggctatcatcggtgcagccactattatcgtcattttccatgaaccagctaaacgggggtaccattccaacggttccatcgttaaccaacattacttcacaaatgggagctttaccatctttagataggatcaccactaatcaaataaatttgccagacccatctagagatgaagcatttgacaactccatcaagcaaatgacgcctatgacaagtgcattcatgaatgctaatactacaattccaagttcaactttaaacgggaatatgaacatgaatggagctggaactgcgaatacagatacaagtgccaacggcagtgctttatcgacactgacaagcccacaaggctcagacttagcatccaattctgctacacagtataaacctgacttagaagactttttgatgcaaaattctaactttaatgggctaatgataaatccttccagtctggtagaagttgttggtggatacaacgatcctaataaccttggaagaaatgacgcggttgattttctacccgttgataatgttgaaattgatggactagtagatttttatagagcagattttccaatatgggag

SEQ ID NO: 142 - protein, 1483 aa, Saccharomyces cerevisiae
MSNTPYNSSVPSIASMTQSSVSRSPNMHTATTPGANTSSNSPPLHMSSDSSKIKRKRNRIPLSCTICRKRKVKCDKLRPHCQQCTKTGVAHLCHYMEQTWAEEAEKELLKDNELKKLRERVKSLEKTLSKVHSSPSSNSLKSYNTPESSNLFMGSDEHTTLVNANTGSASSASHMHQQQQQQQQQEQQQDFSRSANANANSSSLSISNKYDNDELDLTKDFDLLHIKSNGTIHLGATHWLSIMKGDPYLKLLWGHIFAMREKLNEWYYQKNSYSKLKSSKCPINHAQAPPSAAAAATRKCPVDHSAFSSGMVAPKEETPLPRKCPVDHTMFSSGMIPPREDTSSQKRCPVDHTMYSAGMMPPKDETPSPFSTKAMIDHNKHTMNPPQSKCPVDHRNYMKDYPSDMANSSSNPASRCPIDHSSMKNTAALPASTHNTIPHHQPQSGSHARSHPAQSRKHDSYMTESEVLATLCEMLPPKRVIALFIEKFFKHLYPAIPILDEQNFKNHVNQMLSLSSMNPTVNNFGMSMPSSSTLENQPITQINLPKLSDSCNLGILIIILRLTWLSIPSNSCEVDLGEESGSFLVPNESSNMSASALTSMAKEESLLLKHETPVEALELCQKYLIKFDELSSISNNNVNLTTVQFAIFYNFYMKSASNDLTTLTNTNNTGMANPGHDSESHQILLSNITQMAFSCGLHRDPDNFPQLNATIPATSQDVSNNGSKKANPSTNPTLNNNMSAATTNSSSRSGSADSRSGSNPVNKKENQVSIERFKHTWRKIWYYIVSMDVNQSLSLGSPRLLRNLRDFSDTKLPSASRIDYVRDIKELIIVKNFTLFFQIDLCIIAVLNHILNVSLARSVRKFELDSLINLLKNLTYGTENVNDVVSSLINKGLLPTSEGGSVDSNNDEIYGLPKLPDILNHGQHNQNLYADGRNTSSSDIDKKLDLPHESTTRALFFSKHMTIRMLLYLLNYILFTHYEPMGSEDPGTNILAKEYAQEALNFAMDGYRNCMIFFNNIRNTNSLFDYMNVILSYPCLDIGHRSLQFIVCLILRAKCGPLTGMRESSIITNGTSSGFNSSVEDEDVKVKQESSDELKKDDFMKDVNLDSGDSLAEILMSRMLLFQKLTKQLSKKYNYAIRMNKSTGFFVSLLDTPSKKSDSKSGGSSFMLGNWKHPKVSNMSGFLAGDKDQLQKCPVYQDALGFVSPTGANEGSAPMQGMSLQGSTARMGGTQLPPIRSYKPITYTSSNLRRMNETGEAEAKRRRFNDGYIDNNSNNDIPRGISPKPSNGLSSVQPLLSSFSMNQLNGGTIPTVPSLTNITSQMGALPSLDRITTNQINLPDPSRDEAFDNSIKQMTPMTSAFMNANTTIPSSTLNGNMNMNGAGTANTDTSANGSALSTLTSPQGSDLASNSATQYKPDLEDFLMQNSNFNGLMINPSSLVEVVGGYNDPNNLGRNDAVDFLPVDNVEIDGLVDFYRADFPIWE

SEQ ID NO: 143 - DNA, 4506 bp, Saccharomyces cerevisiae
atgtcgaataccccttataattcatctgtgccttccattgcatccatgacccagtcttcggtctcaagaagtcctaacatgcatacagcaactacgcccggtgccaacaccagctctaactctccacccttgcacatgtcttcagattcgtccaagatcaagaggaagcgtaacagaattccgctcagttgcaccatttgtcggaaaaggaaagtcaaatgtgacaaactcagaccacactgccagcagtgcactaaaactggggtagcccatctctgccactacatggaacagacctgggcagaagaggcagagaaagaattgctgaaggacaacgaattaaagaagcttagggagcgcgtaaaatctttagaaaagactctttctaaggtgcactcttctccttcgtctaactccttgaaaagttacaacactcccgagagcagcaacctgtttatgggtagcgatgaacacaccacccttgttaatgcaaatacaggctctgcttcctctgcctcgcatatgcatcagcaacaacagcaacagcagcaacaggaacaacaacaagacttttccagaagtgcgaacgccaacgcgaattcctcgtccctttctatctcaaataaatatgacaacgatgagctggacttaactaaggactttgatcttttgcatatcaaaagtaacggaaccatccacttaggtgccacccactggttgtctatcatgaaaggtgacccgtacctaaaacttttgtggggtcatatcttcgctatgagggaaaagttaaatgaatggtactaccaaaaaaattcgtactctaagctgaagtcaagcaaatgtcccatcaatcacgcgcaagcgccgccttctgccgctgccgccgctaccagaaaatgtcctgttgatcactccgcgttttcgtctggcatggtggccccaaaggaggagactcctcttcctaggaaatgtccagttgaccacaccatgttctcttcgggaatgattcctcccagagaggacacttcgtcccagaagaggtgtcccgttgaccacaccatgtattccgcaggaatgatgccgcccaaggacgagacaccttccccattttccactaaagctatgatagaccataacaagcatacaatgaatccgcctcagtcaaaatgtcctgtggaccatagaaactatatgaaggattatccctctgacatggcaaattcttcttcgaacccggcaagtcgttgccccattgaccattcaagcatgaaaaatacagcggccttaccagcttcaacgcacaataccatcccacaccaccaaccacagtccggatctcatgctcgttcgcatcccgcacaaagcaggaaacatgattcctacatgacagaatctgaagtcctcgcaacactttgtgagatgttgccaccaaagcgcgtcatcgcattattcatcgagaaattcttcaaacatttataccctgccattccaatcttagatgaacagaatttcaaaaatcacgtgaatcaaatgctttcgttgtcttcgatgaatcccacagttaacaactttggtatgagcatgccatcttcatctacactagagaaccaacccataacacaaatcaatcttccaaaactttccgattcttgtaacttaggtattctgataataatcttgagattgacatggctatccataccttctaattcctgcgaagtcgacctgggagaagaaagtggctcatttttagtgcccaacgaatctagcaatatgtctgcatctgcattgacctcgatggctaaagaagaatcacttctgctaaagcatgagacaccggtcgaggcactggagctatgtcaaaaatacttgattaaattcgatgaactttctagtatttccaataacaacgttaatttaaccacggtgcagtttgccattttttacaacttctatatgaaaagtgcctctaatgatttgactaccttgacaaataccaacaacactggcatggccaatcctggtcacgattccgagtctcaccagatcctattgtccaatattactcaaatggcctttagttgtgggttacacagagaccctgataattttcctcaattaaacgctaccattccagcaaccagccaggacgtgtctaacaacgggagcaaaaaggcaaaccctagcaccaatccaactttgaataacaacatgtctgctgccactaccaacagcagtagcagatctggcagtgctgattcaagaagtggttctaaccctgtgaacaagaaggaaaatcaggttagtatcgaaagatttaaacacacttggaggaaaatttggtattacattgttagcatggatgttaaccaatctctttccctggggagccctcgactactaagaaatctgagggatttcagcgatacaaagctaccaagtgcgtcaaggattgattatgttcgcgatatcaaagagttaatcattgtgaagaattttactctttttttccaaattgatttgtgtattattgctgtattaaatcacattttgaatgtttctttagcaagaagcgtgagaaaatttgaactggattcattgattaatttattgaaaaatctgacctatggtactgagaatgtcaatgatgtagtgagctccttgatcaacaaagggttattaccaacttcggaaggtggttctgtagattcaaataatgatgaaatttacggtctaccgaaactacccgatattctaaaccatggtcaacataaccaaaacttgtatgctgatggaagaaatacttctagtagtgatatagataagaaattggaccttcctcacgaatctacaacgagagctctattcttttccaagcatatgacaattagaatgttgctgtacttattgaactacattttgtttactcattatgaaccaatgggcagtgaagatcctggtactaatatcctagctaaggagtacgctcaagaggcattaaattttgccatggatggctacagaaactgcatgattttcttcaacaatatcagaaacaccaattcactattcgattacatgaatgttatcttgtcttacccttgtttggacattggacatcgttctttacaatttatcgtttgtttgatcctgagagctaaatgtggcccattgactggtatgcgtgaatcatcgatcattactaatggtacatcaagtggatttaatagttcggtagaagatgaggacgtcaaagttaaacaagaatcttctgatgaattgaaaaaagacgatttcatgaaagatgtaaatttggattcaggcgattcattagcagagattctaatgtcaagaatgctgctatttcaaaaactaacaaaacaactatcaaagaagtacaactacgctattcgtatgaacaaatccactggattctttgtctctttactagatacaccttcaaagaaatcagactcgaaatcgggtggtagttcattcatgttgggtaattggaaacatccaaaggtttcaaacatgagcggatttcttgctggtgacaaagaccaattacagaaatgccccgtgtaccaagatgcgctggggtttgttagtccaaccggtgctaatgaaggttctgctccgatgcaaggcatgtccttacagggctctactgctaggatgggagggacccagttgccaccaattagatcatacaaacctatcacgtacacaagtagtaatctacgtcgtatgaatgaaacgggtgaggcagaagctaagagaagaagatttaatgatggctatattgataataatagtaacaacgatatacctagaggaatcagcccaaaaccttcaaatgggctatcatcggtgcagccactattatcgtcattttccatgaaccagctaaacgggggtaccattccaacggttccatcgttaaccaacattacttcacaaatgggagctttaccatctttagataggatcaccactaatcaaataaatttgccagacccatctagagatgaagcatttgacaactccatcaagcaaatgacgcctatgacaagtgcattcatgaatgctaatactacaattccaagttcaactttaaacgggaatatgaacatgaatggagctggaactgcgaatacagatacaagtgccaacggcagtgctttatcgacactgacaagcccacaaggctcagacttagcatccaattctgctacacagtataaacctgacttagaagactttttgatgcaaaattctaactttaatgggctaatgataaatccttccagtctggtagaagttgttggtggatacaacgatcctaataaccttggaagaaatgacgcggttgattttctacccgttgataatgttgaaattgatggtgttggaataaaaatcaactatcatctactaactagtatttacgttactagtatattatcatatacggtgttagaagatgacgcaaatgatgagaaa

SEQ ID NO: 144 - protein, 1502 aa, Saccharomyces cerevisiae
MSNTPYNSSVPSIASMTQSSVSRSPNMHTATTPGANTSSNSPPLHMSSDSSKIKRKRNRIPLSCTICRKRKVKCDKLRPHCQQCTKTGVAHLCHYMEQTWAEEAEKELLKDNELKKLRERVKSLEKTLSKVHSSPSSNSLKSYNTPESSNLFMGSDEHTTLVNANTGSASSASHMHQQQQQQQQQEQQQDFSRSANANANSSSLSISNKYDNDELDLTKDFDLLHIKSNGTIHLGATHWLSIMKGDPYLKLLWGHIFAMREKLNEWYYQKNSYSKLKSSKCPINHAQAPPSAAAAATRKCPVDHSAFSSGMVAPKEETPLPRKCPVDHTMFSSGMIPPREDTSSQKRCPVDHTMYSAGMMPPKDETPSPFSTKAMIDHNKHTMNPPQSKCPVDHRNYMKDYPSDMANSSSNPASRCPIDHSSMKNTAALPASTHNTIPHHQPQSGSHARSHPAQSRKHDSYMTESEVLATLCEMLPPKRVIALFIEKFFKHLYPAIPILDEQNFKNHVNQMLSLSSMNPTVNNFGMSMPSSSTLENQPITQINLPKLSDSCNLGILIIILRLTWLSIPSNSCEVDLGEESGSFLVPNESSNMSASALTSMAKEESLLLKHETPVEALELCQKYLIKFDELSSISNNNVNLTTVQFAIFYNFYMKSASNDLTTLTNTNNTGMANPGHDSESHQILLSNITQMAFSCGLHRDPDNFPQLNATIPATSQDVSNNGSKKANPSTNPTLNNNMSAATTNSSSRSGSADSRSGSNPVNKKENQVSIERFKHTWRKIWYYIVSMDVNQSLSLGSPRLLRNLRDFSDTKLPSASRIDYVRDIKELIIVKNFTLFFQIDLCIIAVLNHILNVSLARSVRKFELDSLINLLKNLTYGTENVNDVVSSLINKGLLPTSEGGSVDSNNDEIYGLPKLPDILNHGQHNQNLYADGRNTSSSDIDKKLDLPHESTTRALFFSKHMTIRMLLYLLNYILFTHYEPMGSEDPGTNILAKEYAQEALNFAMDGYRNCMIFFNNIRNTNSLFDYMNVILSYPCLDIGHRSLQFIVCLILRAKCGPLTGMRESSIITNGTSSGFNSSVEDEDVKVKQESSDELKKDDFMKDVNLDSGDSLAEILMSRMLLFQKLTKQLSKKYNYAIRMNKSTGFFVSLLDTPSKKSDSKSGGSSFMLGNWKHPKVSNMSGFLAGDKDQLQKCPVYQDALGFVSPTGANEGSAPMQGMSLQGSTARMGGTQLPPIRSYKPITYTSSNLRRMNETGEAEAKRRRFNDGYIDNNSNNDIPRGISPKPSNGLSSVQPLLSSFSMNQLNGGTIPTVPSLTNITSQMGALPSLDRITTNQINLPDPSRDEAFDNSIKQMTPMTSAFMNANTTIPSSTLNGNMNMNGAGTANTDTSANGSALSTLTSPQGSDLASNSATQYKPDLEDFLMQNSNFNGLMINPSSLVEVVGGYNDPNNLGRNDAVDFLPVDNVEIDGVGIKINYHLLTSIYVTSILSYTVLEDDANDEK

SEQ ID NO: 145 - DNA, 2595 bp, Kluyveromyces lactis
atgggtagtagggcctccaattcgccttctttttcaagtaaggcggaaacgttactgccatcggagtataaaaagaatgcggttaagaaggaaacaatacgcaatggcaagaaaaggaaattgcctgatacagaatcctcagatcctgagtttgcaagtcggcgtttgatagctaatgaaactggcactgatgcggtgagtaatggtaacaaaaatgatagcaatgccaacaacaacaacaacaacaacaacaagaaatcaagtgaagtaatgcaccaggcgtgcgatgcttgcaggaagaagaagtggaaatgttccaagacagtaccgacttgcacgaactgtctgaaatacaatttagactgtgtctactctccgcaagttgttaggactccgttgacaagagcacatttaacagagatggaaaatagggttgcagagttggaacagtttttgaaagaacttttcccagtttgggatatcgataggttacttcagcaaaaagatacatacaggattagggaattgcttactatgggttctacaaatactgttccgggacttgcatcgaataatatcgattcatcgttagaacagcccgttgcctttggtactgcgcagccggcacaatctttgtcaactgatccagcagtacaatctcaagcctatccaatgcaaccggtaccgatgacagagcttcaatctatcaccaatcttcgacacacgccatcacttctggatgaacagcaaatgaacacgatttccacggcaacgctgcggaacatgtactcttcaggtaacaataataacaacttgggtaacatctctggtctatcacctgttacagaggcattcttccgttggcaggaaggtgaaacgtcaatcgataatagttattttggaaaaggttcaattttgttttggttgaaccaattactatcatcagaaaagatcgctggcgttacatcaaaagtaggcaatgacattaacactaataataataatataaaccatcagaagctacctctaatactaaacaataatattactcataatgtgtcggacataaccacaacaagtacatcttcaaacaaaagggcaatgtctcctctttctgccaatgactctgtatatctcgctaaaagagagacaatatccgcgtatatcgatgcgtacttcaagcactatcatgcgctatatccgttggtcagtaaggaaatgtttttcgctcagtataatgatcaaattaaaccagagaacgttgagatatggcacatcttactaaacgcggtattagctttgggttcatggtgctctaattcatgttcaagtcaccatactctctattaccaaaacgcattatcatatttgtccaccgctgtattggaaacagggtccacagatttaaccatagcactcatacttttaacgcattatgttcaaaagatgcataagccaaacactgcatggagtctcataggactttgtagccatatggctacatcgttgggattacaccgggatctaccaaactcaacgatacatgatcagcaactccgtagagtattgtggtggactatttattgcacgggatgcgatctctcattagagactggaaggccctcattattgcccaatcttcaggctattgatataccattaccagcttcatctgccactatcaaagaaccaagcatatattcctccatcatacaagaatcccaatggtctcaaatattgcaacagaaattgtcaaataactcatatcagcaaagtgcaggtgaatgtctctcatggttcgatagtgttcaagcatttttagaccactggcctactcctagtaccgaagctgaactcaaagccttaaatgaaactcaactagattggctaccattagtgaagttccggccatactggatgttccattgttccctaatatcacttttctcagttttttttgaagaagatgccccaaccgacaacaacgtcatacggtgcaaggagttatgccttcaactttcaagcagaaatatatttagcgtggccacttttgtacggagctatgcattcaactcactttcctgttggtacgcgacacattatcttgttagaagcgcattagtgcctctacatttcgcatctcggatatctccacagcacgccttgtgggagacagttaaagcgcaattattatcagcccatgaagcgatgggtatattgtcacaagaatcttccttggccgctaaatttgatgggatattaaccaagaattattctgaaatactacaaagagaaggcatcaacaaaagccaactgatgccaccaccaactccattgctacaatcaaccagtttctcggacctactttcactgtggtcagcaaacgcagaagacgctccgagagtcagtaattcccagatgcctcaatcgatcactatcacggactctttgctacagtcatcaacaactcaaatgagacctccaaccacatctggatggcctgataccaacaacttcctgaatccatcgacccaacagctattcaacaccacaacaatggacgatgtgtacaactatatatttgataacgacgag

SEQ ID NO: 146 - protein, 865 aa, Kluyveromyces lactis
MGSRASNSPSFSSKAETLLPSEYKKNAVKKETIRNGKKRKLPDTESSDPEFASRRLIANETGTDAVSNGNKNDSNANNNNNNNNKKSSEVMHQACDACRKKKWKCSKTVPTCTNCLKYNLDCVYSPQVVRTPLTRAHLTEMENRVAELEQFLKELFPVWDIDRLLQQKDTYRIRELLTMGSTNTVPGLASNNIDSSLEQPVAFGTAQPAQSLSTDPAVQSQAYPMQPVPMTELQSITNLRHTPSLLDEQQMNTISTATLRNMYSSGNNNNNLGNISGLSPVTEAFFRWQEGETSIDNSYFGKGSILFWLNQLLSSEKIAGVTSKVGNDINTNNNNINHQKLPLILNNNITHNVSDITTTSTSSNKRAMSPLSANDSVYLAKRETISAYIDAYFKHYHALYPLVSKEMFFAQYNDQIKPENVEIWHILLNAVLALGSWCSNSCSSHHTLYYQNALSYLSTAVLETGSTDLTIALILLTHYVQKMHKPNTAWSLIGLCSHMATSLGLHRDLPNSTIHDQQLRRVLWWTIYCTGCDLSLETGRPSLLPNLQAIDIPLPASSATIKEPSIYSSIIQESQWSQILQQKLSNNSYQQSAGECLSWFDSVQAFLDHWPTPSTEAELKALNETQLDWLPLVKFRPYWMFHCSLISLFSVFFEEDAPTDNNVIRCKELCLQLSSRNIFSVATFVRSYAFNSLSCWYATHYLVRSALVPLHFASRISPQHALWETVKAQLLSAHEAMGILSQESSLAAKFDGILTKNYSEILQREGINKSQLMPPPTPLLQSTSFSDLLSLWSANAEDAPRVSNSQMPQSITITDSLLQSSTTQMRPPTTSGWPDTNNFLNPSTQQLFNTTTMDDVYNYIFDNDE

SEQ ID NO: 147 - DNA, 2595 bp, Kluyveromyces marxianus var. lactis
atgggtagtagggcctccaattcgccttctttttcaagtaaggcggaaacgttactgccatcggagtataaaaagaatgcggttaagaaggaaacaatacgcaatggcaagaaaaggaaattgcctgatacagaatcctcagatcctgagtttgcaagtcggcgtttgatagctaatgaaactggcactgatgcggtgagtaatggtaacaaaaatgatagcaatgccaacaacaacaacaacaacaacaacaagaaatcaagtgaagtaatgcaccaggcgtgcgatgcttgcaggaagaagaagtggaaatgttccaagacagtaccgacttgcacgaactgtctgaaatacaatttagactgtgtctactctccgcaagttgttaggactccgttgacaagagcacatttaacagagatggaaaatagggttgcagagttggaacagtttttgaaagaacttttcccagtttgggatatcgataggttacttcagcaaaaagatacatacaggattagggaattgcttactatgggttctacaaatactgttccgggacttgcatcgaataatatcgattcatcgttagaacagcccgttgcctttggtactgcgcagccggcacaatctttgtcaactgatccagcagtacaatctcaagcctatccaatgcaaccggtaccgatgacagagcttcaatctatcaccaatcttcgacacacgccatcacttctggatgaacagcaaatgaacacgatttccacggcaacgctgcggaacatgtactcttcaggtaacaataataacaacttgggtaacatctctggtctatcacctgttacagaggcattcttccgttggcaggaaggtgaaacgtcaatcgataatagttattttggaaaaggttcaattttgttttggttgaaccaattactatcatcagaaaagatcgctggcgttacatcaaaagtaggcaatgacattaacactaataataataatataaaccatcagaagctacctctaatactaaacaataatattactcataatgtgtcggacataaccacaacaagtacatcttcaaacaaaagggcaatgtctcctctttctgccaatgactctgtatatctcgctaaaagagagacaatatccgcgtatatcgatgcgtacttcaagcactatcatgcgctatatccgttggtcagtaaggaaatgtttttcgctcattataatgatcaaattaaaccagagaacgttgagatatggcacatcttactaaacgcggtattagctttgggttcatggtgctctaattcatgttcaagtcaccatactctctattaccaaaacgcattatcatatttgtccaccgctgtattggaaacagggtccacagatttaaccatagcactcatacttttaacgcattatgttcaaaagatgcataagccaaacactgcatggagtctcataggactttgtagccatatggctacatcgttgggattacaccgggatctaccaaactcaacgatacatgatcagcaactccgtagagtattgtggtggactatttattgcacgggatgcgatctctcattagagactggaaggccctcattattgcccaatcttcaggctattgatataccattaccagcttcatctgccactatcaaagaaccaagcatatattcctccatcatacaagaatcccaatggtctcaaatattgcaacagaaattgtcaaataactcatatcagcaaagtgcaggtgaatgtctctcatggttcgatagtgttcaagcatttttagaccactggcctactcctagtaccgaagctgaactcaaagccttaaatgaaactcaactagattggctaccattagtgaagttccggccatactggatgttccattgttccctaatatcacttttctcagttttttttgaagaagatgccccaaccgacaacaacgtcatacggtgcaaggagttatgccttcaactttcaagcagaaatatatttagcgtggccacttttgtacggagctatgcattcaactcactttcctgttggtacgcgacacattatcttgttagaagcgcattagtgcctctacatttcgcatctcggatatctccacagcacgccttgtgggagacagttaaagcgcaattattatcagcccatgaagcgatgggtatattgtcacaagaatcttccttggccgctaaatttgatgggatattaaccaagaattattctgaaatactacaaagagaaggcatcaacaaaagccaactgatgccaccaccaactccattgctacaatcaaccagtttctcggacctactttcactgtggtcagcaaacgcagaagacgctccgagagtcagtaattcccagatgcctcaatcgatcactatcacggactctttgctacagtcatcaacaactcaaatgagacctccaaccacatctggatggcctgataccaacaacttcctgaatccatcgacccaacagctattcaacaccacaacaatggacgatgtgtacaactatatatttgataacgacgag

SEQ ID NO: 148 - protein, 865 aa, Kluyveromyces marxianus var. lactis
MGSRASNSPSFSSKAETLLPSEYKKNAVKKETIRNGKKRKLPDTESSDPEFASRRLIANETGTDAVSNGNKNDSNANNNNNNNNKKSSEVMHQACDACRKKKWKCSKTVPTCTNCLKYNLDCVYSPQVVRTPLTRAHLTEMENRVAELEQFLKELFPVWDIDRLLQQKDTYRIRELLTMGSTNTVPGLASNNIDSSLEQPVAFGTAQPAQSLSTDPAVQSQAYPMQPVPMTELQSITNLRHTPSLLDEQQMNTISTATLRNMYSSGNNNNNLGNISGLSPVTEAFFRWQEGETSIDNSYFGKGSILFWLNQLLSSEKIAGVTSKVGNDINTNNNNINHQKLPLILNNNITHNVSDITTTSTSSNKRAMSPLSANDSVYLAKRETISAYIDAYFKHYHALYPLVSKEMFFAHYNDQIKPENVEIWHILLNAVLALGSWCSNSCSSHHTLYYQNALSYLSTAVLETGSTDLTIALILLTHYVQKMHKPNTAWSLIGLCSHMATSLGLHRDLPNSTIHDQQLRRVLWWTIYCTGCDLSLETGRPSLLPNLQAIDIPLPASSATIKEPSIYSSIIQESQWSQILQQKLSNNSYQQSAGECLSWFDSVQAFLDHWPTPSTEAELKALNETQLDWLPLVKFRPYWMFHCSLISLFSVFFEEDAPTDNNVIRCKELCLQLSSRNIFSVATFVRSYAFNSLSCWYATHYLVRSALVPLHFASRISPQHALWETVKAQLLSAHEAMGILSQESSLAAKFDGILTKNYSEILQREGINKSQLMPPPTPLLQSTSFSDLLSLWSANAEDAPRVSNSQMPQSITITDSLLQSSTTQMRPPTTSGWPDTNNFLNPSTQQLFNTTTMDDVYNYIFDNDE

SEQ ID NO: 149 - DNA, 2658 bp, Saccharomyces cerevisiae
atggaaggaagatcagattttgtggcgacttcacagtccggaagtgaaatgagccatagtgaaactaggaatagaactgggatgaatgctaggaaaaggaaattcgcctgtgtggaatgtcgtcagcagaagtcgaaatgtgatgctcacgaaagagcaccggagccatgcactaagtgtgctaaaaagaatgtcccatgcattttaaaacgagatttcagaagaacttataaaagagcaaggaacgaagccattgaaaaaagattcaaggaactcaccagaactttgacaaatttaacttcggatgaaattttgaagaaaattgaagaggaacaggaaattgttttggataacagtaatttcacaaaagaaaaagtaaaacaactcaggaagagtgcttttgagacgacagaaatagaaccgagatcatacaaaacacttcgaggagaacctatttcttacagtaccaacagaagacatacggattcttctcctttaacgctcttaagctcgtcgacaaacttcgaccctgttcactcaacaaacgttatgacagatgatcaacttaagtgcttgccaaaaagcctgggcgacgtatatttgtcaagcagcgatattgctgagctgtttcaagaatttgcgacaaaatatcatcaatttttacccgtcgttgacctttcgaaaggagcagagcgaatttatcacttatctccttgcttattctgggtcatcctgctcattggtttaaggcggaaatttggggctacagacttaatgactcgattatcagtgctagtaaagtcagttttatcagaaatcacaatatctccaataattcgatatactccatcagataaggacgaacccgttctaaatgtagcatctgtatattccgtgcaagcatttcttttatacacgttctggcctcccttaacctcttcattaagcgccgacacttcgtggaataccataggaacagcgatgttccaagcgcttcgggtaggactaaattgtgcaggtttttcaaaagagtatgcttcggcaaattcagaattagttaacgagcaaatacgaacttggatttgctgcaatgttgtatctcaaacagttgcatcatcatttggtttcccagcttatgtttcatttgattatttagtaatcagctctattagagtaccaaattcaaaaagccaagtagatatacccaatgaactaagacaaatggctcaaattgctagatttgagaaccaaatcgtaaacacaatgaactccaccccggcgagtgttactgggatggtaagtcaggaagagaagcagcccttgttacacgttcttaatcaacaactaagtcaattggagattagtcttgaagaaaataacctagatgatatccgaaaatttttattactagtggccaaggttcacttattaacctattacttcactgatgttacctcccaaagtgctggaaaatcaaatggtaatatttatgagggatcatattccattatggaactcgatacaagttttgaaacgaaacgtggattggtgaaagtttataatgccgccgtaaactttcttatacatgccaatagtatgtgggaacatgatcctaccattattaagtactttcctggtttgtttgtcttgaatatatggcaatctgcctgtattattagtaaactcatacattcatcacttcattcaatgctagatgttaactcaggcaaaaaagcttataacaacgcaatttcattgacgtttaatgcctcagttttaaaatatgatatggcgtacagatcatccggaataatgcgaagcatatggagtttatttgctaatatgtatgatgcctggaaaaacgaccaaaaggaaggtggaggtagactaaataatgatttcaatttaggcatcaccataaaatctaggatgtcagtaaacgttttttttgactgcttatatattctaaaagagaaatgtggtatggccaaattggagagagagaccaaggtttctacagcttacaatgttgatgaagaggaagaggaagatgaagatgaggagggagaagaagaagaagaagaagaagaactaagtagtaaagttccagaaaatatggatagccagcaactaaggacaaggaaattcaccaatgtaaggcatccagaaaagaaagcaagaaaaataattgaaacaattccgctagacccaaatccaataaatgcaggctctaccagcagtggaagctcattaacgaccccaaatagtcaagtagcgaacactatatcatatagaggaatcctcaataaaatgtcacctagggaacaactgaatcatgcaaatttagattccagtgtttctacagacatcaaggacactgaagctgtcaatgaacctctgccaatagggaggaatgctgaacatccggcaaatcaaccgcctctttcaataacacaaatgcaagaaaacacactacctgcgacacaagccaactcttctctattagaaacgtatcccattgttcaatcaaaccccgttacaactacaatcaaagaatcacccaattccatcatggcaggttgggataactgggaatctgatatggtttggagggatgttgatattttaatgaatgaatttgcgttcaatcccaaggtt

SEQ ID NO: 150 - protein, 886 aa, Saccharomyces cerevisiae
MEGRSDFVATSQSGSEMSHSETRNRTGMNARKRKFACVECRQQKSKCDAHERAPEPCTKCAKKNVPCILKRDFRRTYKRARNEAIEKRFKELTRTLTNLTSDEILKKIEEEQEIVLDNSNFTKEKVKQLRKSAFETTEIEPRSYKTLRGEPISYSTNRRHTDSSPLTLLSSSTNFDPVHSTNVMTDDQLKCLPKSLGDVYLSSSDIAELFQEFATKYHQFLPVVDLSKGAERIYHLSPCLFWVILLIGLRRKFGATDLMTRLSVLVKSVLSEITISPIIRYTPSDKDEPVLNVASVYSVQAFLLYTFWPPLTSSLSADTSWNTIGTAMFQALRVGLNCAGFSKEYASANSELVNEQIRTWICCNVVSQTVASSFGFPAYVSFDYLVISSIRVPNSKSQVDIPNELRQMAQIARFENQIVNTMNSTPASVTGMVSQEEKQPLLHVLNQQLSQLEISLEENNLDDIRKFLLLVAKVHLLTYYFTDVTSQSAGKSNGNIYEGSYSIMELDTSFETKRGLVKVYNAAVNFLIHANSMWEHDPTIIKYFPGLFVLNIWQSACIISKLIHSSLHSMLDVNSGKKAYNNAISLTFNASVLKYDMAYRSSGIMRSIWSLFANMYDAWKNDQKEGGGRLNNDFNLGITIKSRMSVNVFFDCLYILKEKCGMAKLERETKVSTAYNVDEEEEEDEDEEGEEEEEEEELSSKVPENMDSQQLRTRKFTNVRHPEKKARKIIETIPLDPNPINAGSTSSGSSLTTPNSQVANTISYRGILNKMSPREQLNHANLDSSVSTDIKDTEAVNEPLPIGRNAEHPANQPPLSITQMQENTLPATQANSSLLETYPIVQSNPVTTTIKESPNSIMAGWDNWESDMVWRDVDILMNEFAFNPKV

SEQ ID NO: 151 - DNA, 1509 bp, Aspergillus terreus
atggctgcagatcaaggtatattcacgaactcggtcactctctcgccagtggagggttcacgcaccggtggaacattaccccgccgtgcattccgacgctcttgtgatcggtgtcatgcacaaaagatcaaatgtactggaaataaggaggttactggccgtgctccctgtcagcgttgccagcaggctggacttcgatgcgtctacagtgagcgatgccccaagcgcaagctacgccaatccagggcagcggatctcgtctctgctgacccagatccctgcttgcacatgtcctcgcctccagtgccctcacagagcttgccgctagacgtatccgagtcgcattcctcaaatacctcccggcaatttcttgatccaccggacagctacgactggtcgtggacctcgattggcactgacgaggctattgacactgactgctgggggctgtcccaatgtgatggaggcttcagctgtcagttagagccaacgctgccggatctaccttcgcccttcgagtctacggttgaaaaagctccgttgccaccggtatcgagcgacattgctcgtgcggccagtgcgcaacgagagcttttcgatgacctgtcggcggtgtcgcaggaactggaagagatccttctggccgtgacggtagaatggccgaagcaggaaatctggacccgtgcgtcgccgcattccccaactgcttcccgtgagaggatagcacagcgccgacaaaacgtatgggcaaactggctaacagacttgcatatgttctcactagatcccatcggaatgtttttcaatgcgtcacgacggcttcttactgtcctgcgccaacaagcgcaggccgactgccatcaaggcacactagacgaatgtttacggaccaagaacctctttacggcagtacactgttacatattgaatgtgcggattttgaccgccatatcggagttgctcctgtcgcaaattaggcggacccagaacagccatatgagcccactggaagggagtcgatcccagtcgccgagcagagacgacaccagcagcagcagcggccacagcagtgttgacaccatacccttctttagcgagaacctccctattggtgagctgttctcctatgttgaccccctgacacacgccctattctcggcttgcactacgttacatgttggggtacaattgctgcgtgagaatgagattactctgggagtacactccgcccagggcattgcagcttccatcagcatgagcggggaaccaggcgaggatatagccaggacaggggcgaccaattccgcaagatgcgaggagcagccgaccactccagcggctcgggttttgttcatgttcttgagtgatgaaggggctttccaggaggcaaagtctgctggttcccgaggtcgaaccatcgcagcactgcgacgatgctatgaggatatcttttccctcgcccgcaaacacaaacatggcatgctcagagacctcaacaatattcctcca

SEQ ID NO: 152 - protein, 503 aa, Aspergillus terreus
MAADQGIFTNSVTLSPVEGSRTGGTLPRRAFRRSCDRCHAQKIKCTGNKEVTGRAPCQRCQQAGLRCVYSERCPKRKLRQSRAADLVSADPDPCLHMSSPPVPSQSLPLDVSESHSSNTSRQFLDPPDSYDWSWTSIGTDEAIDTDCWGLSQCDGGFSCQLEPTLPDLPSPFESTVEKAPLPPVSSDIARAASAQRELFDDLSAVSQELEEILLAVTVEWPKQEIWTRASPHSPTASRERIAQRRQNVWANWLTDLHMFSLDPIGMFFNASRRLLTVLRQQAQADCHQGTLDECLRTKNLFTAVHCYILNVRILTAISELLLSQIRRTQNSHMSPLEGSRSQSPSRDDTSSSSGHSSVDTIPFFSENLPIGELFSYVDPLTHALFSACTTLHVGVQLLRENEITLGVHSAQGIAASISMSGEPGEDIARTGATNSARCEEQPTTPAARVLFMFLSDEGAFQEAKSAGSRGRTIAALRRCYEDIFSLARKHKHGMLRDLNNIPP

SEQ ID NO: 153 - DNA, 1407 bp, Aspergillus terreus
atggctgcagatcaaggtatattcacgaactcggtcactctctcgccagtggagggttcacgcaccggtggaacattaccccgccgtgcattccgacgctcttgtgatcggtgtcatgcacaaaagatcaaatgtactggaaataaggaggttactggccgtgctccctgtcagcgttgccagcaggctggacttcgatgcgtctacagtgagcgatgccccaagcgcaagctacgccaatccagggcagcggatctcgtctctgctgacccagatccctgcttgcacatgtcctcgcctccagtgccctcacagagcttgccgctagacgtatccgagtcgcattcctcaaatacctcccggcaatttcttgatccaccggacagctacgactggtcgtggacctcgattggcactgacgaggctattgacactgactgctgggggctgtcccaatgtgatggaggcttcagctgtcagttagagccaacgctgccggatctaccttcgcccttcgagtctacggttgaaaaagctccgttgccaccggtatcgagcgacattgctcgtgcggccagtgcgcaacgagagcttttcgatgacctgtcggcggtgtcgcaggaactggaagagatccttctggccgtgacggtagaatggccgaagcaggaaatctggacccatcccatcggaatgtttttcaatgcgtcacgacggcttcttactgtcctgcgccaacaagcgcaggccgactgccatcaaggcacactagacgaatgtttacggaccaagaacctctttacggcagtacactgttacatattgaatgtgcggattttgaccgccatatcggagttgctcctgtcgcaaattaggcggacccagaacagccatatgagcccactggaagggagtcgatcccagtcgccgagcagagacgacaccagcagcagcagcggccacagcagtgttgacaccatacccttctttagcgagaacctccctattggtgagctgttctcctatgttgaccccctgacacacgccctattctcggcttgcactacgttacatgttggggtacaattgctgcgtgagaatgagattactctgggagtacactccgcccagggcattgcagcttccatcagcatgagcggggaaccaggcgaggatatagccaggacaggggcgaccaattccgcaagatgcgaggagcagccgaccactccagcggctcgggttttgttcatgttcttgagtgatgaaggggctttccaggaggcaaagtctgctggttcccgaggtcgaaccatcgcagcactgcgacgatgctatgaggatatcttttccctcgcccgcaaacacaaacatggcatgctcagagacctcaacaatattcctcca

SEQ ID NO: 154 - protein, 469 aa, Aspergillus terreus
MAADQGIFTNSVTLSPVEGSRTGGTLPRRAFRRSCDRCHAQKIKCTGNKEVTGRAPCQRCQQAGLRCVYSERCPKRKLRQSRAADLVSADPDPCLHMSSPPVPSQSLPLDVSESHSSNTSRQFLDPPDSYDWSWTSIGTDEAIDTDCWGLSQCDGGFSCQLEPTLPDLPSPFESTVEKAPLPPVSSDIARAASAQRELFDDLSAVSQELEEILLAVTVEWPKQEIWTHPIGMFFNASRRLLTVLRQQAQADCHQGTLDECLRTKNLFTAVHCYILNVRILTAISELLLSQIRRTQNSHMSPLEGSRSQSPSRDDTSSSSGHSSVDTIPFFSENLPIGELFSYVDPLTHALFSACTTLHVGVQLLRENEITLGVHSAQGIAASISMSGEPGEDIARTGATNSARCEEQPTTPAARVLFMFLSDEGAFQEAKSAGSRGRTIAALRRCYEDIFSLARKHKHGMLRDLNNIPP

SEQ ID NO: 155 - DNA, 2226 bp, Aspergillus terreus
atggagagtgcagagctgtcgtcgaagcggcaggcatttcctgcatgtgatgagtgccggatccgtaaggtccgatgcagcaaggagggtccaaagtgctcccattgcctccgatataacctaccctgtgaattctccaacaaagtggcgcgcgacgtcgagaagctcgggagtcgggttggagatatcgaacatgccctccaacgatgcctgtcctttattgatgcccatcagggctttcgtgatctatcaaggccacagtcacaagaaagcgggtacacaagctcaaccagctcagaagagtgtgaagtaaacttgtactcaggcaaacacacttcacccaccgaggaagatggattctggcctctccacggttatggctcttttgtttcactcgtcatggaggcacaggctgctaacgccaacctaacctcttggttaccggtcgatatgaccagcggccaagtcgcagagatggtcgcatttgaccgccaagctgtgtcagctgtgcgctcgaaggtggctgaggcgaatgaaacgcttcaacagatcattgaggatatcccaacactatcggcatccgaaaacgatacctttctcccgtctcttccaccccgcgctctagtggagccgtctatcaacgaatatttcaagaagctgcatccacgactccctatatttagtcgacagactattatggacgcagtggaatctcagtacacaatcagaactgggcctccggacctggtttggattacctctttcaactgcattgtgcttcaggccctgactcaaacatcaattgcgaacaaagtcgtgggatgcacaggacaagacataccaatagattatatgatcataagcctgctgcgtaatatcaggcagtgctataatcgattggaaactcttgttaaaccccggctatcgaatatacgggccctcttttgtttggcacttgtggcaatggagtattttgatttcgcaatttttctgactatctttgctcaagtctgcgagttgtccaggctcattggactccatttaacgacaacgaccccgccaacggaagatggggctgtgggcgaccagcctaaagacttgttctggagcatcttcctcgtcgataagcacgtatccatcattgggggcaaggcctgcctattgccctcgtatgactgcagcgtaccattgcctccatatgactccgctgcgccactaccaaatgcttttgcggcacgcatacgcttggcattcattcttgaggagatatatctgggcttatactcagcaaaatccagcaaaatggaacagagtcgcgtccgccgccgtatccgcagaattgctcgaaaacttagccagtggcacgtgcaacatgagcatgtactgcgtaccggagatccgaataggcctctcgaagagtatatctgtgcaacgcagttgaggtttgcactctcgagctgttgggtacttctgcataaacgcatttggagccaggaaaggggcgctgtctgcctacaacacgctcgggattgtctgatgctgttcaagcaattgtgcgatgggtgtaaatctggtttcagcaatttcgacagcattgtcctgaactattctttgatctcattcatgggaatctatgtccacattgtggaggaagaccagccgatccattcacaggacatggagatactcactttcttcgccatatacacgaaccgttcggcatccaataggtcatctgcatctatctcgtacaaattaagccaagtggccagtcgctgtagcgatattgccctcctcctccagaatttaagggagaggcgttttattccgacaacgatatcacgaagtccaacgccctcatggaacgagccaacctacatggattacgatgtcgccaatgcgtccactagcacaactagcaccggctcttcatataacttgaatatcagcccgcttggtgtacccggagacggccaggtctgggacatatacttcaacccgagagaaataccaatggatggtacaattgcgactccttctgaggatgcaacccaggatttgctgagcaatgatgctggccaatgccttggtttccccgacttttcacttggcattgacaacttctccgactttccacttggcattgacatgactagccaaagcgaatttggtcttattatggaggaggacataattcgatatgagagactactagataggcccgtt

SEQ ID NO: 156 - protein, 742 aa, Aspergillus terreus
MESAELSSKRQAFPACDECRIRKVRCSKEGPKCSHCLRYNLPCEFSNKVARDVEKLGSRVGDIEHALQRCLSFIDAHQGFRDLSRPQSQESGYTSSTSSEECEVNLYSGKHTSPTEEDGFWPLHGYGSFVSLVMEAQAANANLTSWLPVDMTSGQVAEMVAFDRQAVSAVRSKVAEANETLQQIIEDIPTLSASENDTFLPSLPPRALVEPSINEYFKKLHPRLPIFSRQTIMDAVESQYTIRTGPPDLVWITSFNCIVLQALTQTSIANKVVGCTGQDIPIDYMIISLLRNIRQCYNRLETLVKPRLSNIRALFCLALVAMEYFDFAIFLTIFAQVCELSRLIGLHLTTTTPPTEDGAVGDQPKDLFWSIFLVDKHVSIIGGKACLLPSYDCSVPLPPYDSAAPLPNAFAARIRLAFILEEIYLGLYSAKSSKMEQSRVRRRIRRIARKLSQWHVQHEHVLRTGDPNRPLEEYICATQLRFALSSCWVLLHKRIWSQERGAVCLQHARDCLMLFKQLCDGCKSGFSNFDSIVLNYSLISFMGIYVHIVEEDQPIHSQDMEILTFFAIYTNRSASNRSSASISYKLSQVASRCSDIALLLQNLRERRFIPTTISRSPTPSWNEPTYMDYDVANASTSTTSTGSSYNLNISPLGVPGDGQVWDIYFNPREIPMDGTIATPSEDATQDLLSNDAGQCLGFPDFSLGIDNFSDFPLGIDMTSQSEFGLIMEEDIIRYERLLDRPV

SEQ ID NO: 157 - DNA, 2370 bp, Saccharomyces cerevisiae
atgttcgaatctgtcaatttggatgaaaattctccagaggatagagaactggctaaggttttgtccccaccgggtagttatctttctccagcttcactagacagtggttcatcgttcacaaatagtgggacttcaactagttgctttgaaccaaaaaacaatctaccctccttatcgtttttaaatgctagagcgggatctttaggtggcatttttaatcataaacagatgacctcgccgtcaaattcgaatataggaggcgaaaatgtagaatcgaccacaagtagtaatgacggcagtaatgaaaatgcaggtcatcccactacttcagagcaagatcaaaatgcagatcaccccactatttcacaggcagatgataatggacactcatcgttgacccctaatcctgctgtaacttcaactgttacggataagaagggaaatacagtaaaacggaagtactccagaaatgggtgctccgagtgtaagagacgaagaatgaaatgtgatgaaactaaaccgacttgttggcagtgcgcaagattgaatcgtcagtgcgtttacgttttaaacccaaaaaataagaaaagaagaacctcaaatgctcaaagagtaaaagaatttaggaagcacagtactagcctcgataatgatcataataatgctcgcaagcgtcagcattcgtcatgcaaggctgagaagaagaaaaaagtacgacaaaatttaagtgaagacaccacggaccctaaaccgattacagataacggcaagaatgtacctttggatgaaatagaatccctagagattccaaatttggaccttaccaccacaatgaatggatatgacgttaatttactaatgcagaacttgaatgatatggttaatatgaaacttcatgactcttacttattgaatgaagaactgaaaggattagatttgcccgatttggacatacctgaacttttgcccgcttcgaatgtgaacagtagcgtaccaatatcctttctggtgaataatgtaataactttcaacacaaaactaagctcgttcaaactaggtggaatccacgataagtatctaaagatattttactacgattgcttagattctattgcgccctttttccaaaatcaagggaacccgttaagagatatcttactttcatttgcgaaaaacgaggcctatcttttatcttccatattagctacgggagcatctatagcatatagaaagtctaataacttggaagatgaacgaaactattgtgcttatttgtcacattgcctgagcctgttgggtgaacaattcaagaatgagtcaaacgttttaaataggatagagcctatcatcctgacggtcatcatgcttgcatgggattgtatttattcaatgaattctcaatggaggtctcacttaaaaggtgtaactgacctttttaaaaaaatcaatgccgggaattcctccaaagtacttaacgttgcaaaatgttggtttaaagttatggaaacattcgccagtataagtacggtatttggcggatctttaattgataataatgaccttgatgcaatttttgatccatatgattaccaatatgttgactcgttaaaatttttaaatattatgactccactaaatgagtttaatcttttaagaggacataaagaagatttcgatcttgttattaaagaagttttcaaatcactcaatacaattaggtcaactgaaaaaaattacttttctaaagaagaaggtttgttcactaagaaattagactatctgcttttatcatcccaaacttcgtccgaaaagtccaaagaccagatatcatatttcaatacgcagaaaattctagtggaaattgacaagcaattagattacgaatttattgacaaatctggaattataccctcagacaatcagtcacaccctagaattagtaatattcatgataatgccatcgatatggtgacattaaagaacggtgaagaagttgccatcagctggtatgatatttctcatcagacacaagttttatctttcttattaattgtattattaaaacttttaggtatgccaaaagagtcaagtaccattcaacaagtggtcaagaaaatcatgtctttcttcaaattcttagacagtgactcgccgccacaaaattcaaggacttgttatagtaattttgctgtattgattgcaggtttgaatgcaatggacgaggaaacaagagcgattgttaaaagatattataaaatcaatggtggaaaatttcaaaagctcacagaacataatcttaacagactggaaaaggtctggtatggtaaaaatcaaaattacaggttagaagaacaagacgttttaacatgg

SEQ ID NO: 158 - protein, 790 aa, Saccharomyces cerevisiae
MFESVNLDENSPEDRELAKVLSPPGSYLSPASLDSGSSFTNSGTSTSCFEPKNNLPSLSFLNARAGSLGGIFNHKQMTSPSNSNIGGENVESTTSSNDGSNENAGHPTTSEQDQNADHPTISQADDNGHSSLTPNPAVTSTVTDKKGNTVKRKYSRNGCSECKRRRMKCDETKPTCWQCARLNRQCVYVLNPKNKKRRTSNAQRVKEFRKHSTSLDNDHNNARKRQHSSCKAEKKKKVRQNLSEDTTDPKPITDNGKNVPLDEIESLEIPNLDLTTTMNGYDVNLLMQNLNDMVNMKLHDSYLLNEELKGLDLPDLDIPELLPASNVNSSVPISFLVNNVITFNTKLSSFKLGGIHDKYLKIFYYDCLDSIAPFFQNQGNPLRDILLSFAKNEAYLLSSILATGASIAYRKSNNLEDERNYCAYLSHCLSLLGEQFKNESNVLNRIEPIILTVIMLAWDCIYSMNSQWRSHLKGVTDLFKKINAGNSSKVLNVAKCWFKVMETFASISTVFGGSLIDNNDLDAIFDPYDYQYVDSLKFLNIMTPLNEFNLLRGHKEDFDLVIKEVFKSLNTIRSTEKNYFSKEEGLFTKKLDYLLLSSQTSSEKSKDQISYFNTQKILVEIDKQLDYEFIDKSGIIPSDNQSHPRISNIHDNAIDMVTLKNGEEVAISWYDISHQTQVLSFLLIVLLKLLGMPKESSTIQQVVKKIMSFFKFLDSDSPPQNSRTCYSNFAVLIAGLNAMDEETRAIVKRYYKINGGKFQKLTEHNLNRLEKVWYGKNQNYRLEEQDVLTW

SEQ ID NO: 159 - DNA, 1410 bp, Saccharomyces pastorianus
atgggtattgcgaaacagtcttgcgactgctgtcgcgttcgtcgagtaaagtgtgacaggaataaaccatgtaatcgctgcactcagcgcaatttgaactgcacttatcttcaaccgttgaaaaagagaggtccaaaatccattagagcaggaagcttaaaaaaaatagcggaagtgcagatggtgagtatgaataataatattatgaccgctccggtggtatgtaagaaggttccgaaaaacctgattgatcaatgtttgaggctgtatcatgataacttatatgtaatttggccaatgctttcctacgatgatcttcacaagcttctagaagagaaatacgatgactgttgcgcctactggtttctggtatccctttcggcagctactcttagcgacttgcaaattgaaatagagtatgaggaaggagtcacttttactggagagcagttatgcactctttgcatgttatctcggcaattctttgacgaccttagtaacagcgacataattcgaatcatgacatactattgtttgcaccgttgttacgcgcagtttgcggatacgagaacttcatatagactttcttgtgaagccgtgggcctcatcaagatagctggattccatcgggaagaaacctatgaattccttcccttcggtgaacaacaactcagaaggaaagtttactatttacttcttatgacagagagatattacgctgtatatattaagtgtgtcacgagcctagatacaacaatagcgccaccactaccagaggttgtaacagaccctcgtctttctctggaaagcttccttgaggtgattagagttttcactgtacctggaaagtgtttttatgatgctttggctactaactgtgtcgatgattcctgcaccgaagactctctaaaaaggatatggaatgaacttcacacaacctcacttgatatagagccatactcttacggatacatagactatctcttttctcggcactgggtcaggactctagcatggaagttggtactaaataagaaggatatgcggatgaattttttttcgaatactaacgccacacacattccagtcgaaatagccaaggatatgttacaggatacacttttaactccaatcgacctatatgatgtgcatggtcctggcgtaccgatgaaggcgctagaaatagccaatgcattggtagacgtcgtaagtaagtatgatcacaatatgaagttggaggcttggaatattttgtgcgatgtatctaagttcgttttctccctgaaacattgcaatcataaaatgtttcaaaggttttcaactaaatgtcagagtgctctaatcgatttgcctatctctagaccactgcgcctaaatgatgattccaaagatgaagacgacataattcct

SEQ ID NO: 160 - protein, 470 aa, Saccharomyces pastorianus
MGIAKQSCDCCRVRRVKCDRNKPCNRCTQRNLNCTYLQPLKKRGPKSIRAGSLKKIAEVQMVSMNNNIMTAPVVCKKVPKNLIDQCLRLYHDNLYVIWPMLSYDDLHKLLEEKYDDCCAYWFLVSLSAATLSDLQIEIEYEEGVTFTGEQLCTLCMLSRQFFDDLSNSDIIRIMTYYCLHRCYAQFADTRTSYRLSCEAVGLIKIAGFHREETYEFLPFGEQQLRRKVYYLLLMTERYYAVYIKCVTSLDTTIAPPLPEVVTDPRLSLESFLEVIRVFTVPGKCFYDALATNCVDDSCTEDSLKRIWNELHTTSLDIEPYSYGYIDYLFSRHWVRTLAWKLVLNKKDMRMNFFSNTNATHIPVEIAKDMLQDTLLTPIDLYDVHGPGVPMKALEIANALVDVVSKYDHNMKLEAWNILCDVSKFVFSLKHCNHKMFQRFSTKCQSALIDLPISRPLRLNDDSKDEDDIIP

SEQ ID NO: 161 - DNA, 1419 bp, Saccharomyces cerevisiae
atgactttaactaagcaaacatgcgccaagcaggcatgcgactgctgtcgtattcgtcgagtgaaatgcgatggtaaaaggccgtgtagcagttgcctacagaatagtttggattgcacttatctgcaaccgtcgagaaaaagaggtccgaagtccattaggttgaggagcttgaaaagaatagcagaagtgcagagggaaagcggtcctaacaccattgcaactgctcctgtaatatataagagggttcccaaaaagctaatcgatcagtgcttgcggctctatcacgataatttatacgtaatctggccccttctttcgtacgatgaccttcacaaacttctggaggaaaaatacaatgacaattacgtatattggtttctgaccgctttatcagcggccaccctcagtgatttacaaactgaaataaaatctgaagaggaagtcactttcacgggaaaacagttatctaatctttgcatctcatcgtgtcagcaatttgacgatttggataacagcaatatattcaatattatgacgtactactgtttgcatcgtagctttgcacaaatatcgaacgcaagaacttcttacagactctgttgtgaagcggtcggtctgattacggtagcagggttacatcgggaagaaacttacggatcccttacatttgaagaacagcaacttagacggaaactttattacttgcttctcatgacggagagatactatgccatatatcttcattgtgcgacgagcctggatgccacaatagcaccaccgcaacttgaacttgtaactgatcctcagctttctatggacagtttccttgaaatgattagggtatttactgtaccaggaaaatgtttcttcgatgctttagccgctgactctacagatgcttcttgcactgaagagtcattgaaaaagatatggaacgaactccacacaacttcctcggaaatagagccatggtctaacggttacatagacatctcattttcccggcattggattaggatactagcatggaagctagcttatcaaatgaggggtagcaacttttcattgaacgctaacaatgggcaaataccaatagaaattgcgagagatatgttaatagacacttacttaaccccagagaatctttacgatgtccatggtcccggggtaccagtgaaaacattagaaatagctactgctttggtggacattgtaggccagtatgatcataacatgaaattagaagcatggaatgttttgcatgatgtatgcaaatttgctttttctttaaaccactataacaatgatatgctgaagagattttccaccaaatgccagaatgccctaattactctgcccatttctaaacctttacaattggatggttatcccaaggataatgaagacatagaccct

SEQ ID NO: 162 - protein, 473 aa, Saccharomyces cerevisiae
MTLTKQTCAKQACDCCRIRRVKCDGKRPCSSCLQNSLDCTYLQPSRKRGPKSIRLRSLKRIAEVQRESGPNTIATAPVIYKRVPKKLIDQCLRLYHDNLYVIWPLLSYDDLHKLLEEKYNDNYVYWFLTALSAATLSDLQTEIKSEEEVTFTGKQLSNLCISSCQQFDDLDNSNIFNIMTYYCLHRSFAQISNARTSYRLCCEAVGLITVAGLHREETYGSLTFEEQQLRRKLYYLLLMTERYYAIYLHCATSLDATIAPPQLELVTDPQLSMDSFLEMIRVFTVPGKCFFDALAADSTDASCTEESLKKIWNELHTTSSEIEPWSNGYIDISFSRHWIRILAWKLAYQMRGSNFSLNANNGQIPIEIARDMLIDTYLTPENLYDVHGPGVPVKTLEIATALVDIVGQYDHNMKLEAWNVLHDVCKFAFSLNHYNNDMLKRFSTKCQNALITLPISKPLQLDGYPKDNEDIDP

SEQ ID NO: 163 - DNA, 1410 bp, Saccharomyces cerevisiae
atgggtattgcgaaacagtcttgcgactgctgtcgcgttcgtcgagtaaagtgtgacaggaataaaccatgtaatcgctgcactcagcgcaatttgaactgcacttatcttcaaccgttgaaaaagagaggtccaaaatccattagagcaggaagcttaaaaaaaatagcggaagtgcagatggtgagtatgaataataatattatgaccgctccggtggtatgtaagaaggttccgaaaaacctgattgatcaatgtttgaggttgtatcatgataacttatatgtaatttggccaatgctttcctacgatgatcttcacaagcttttggaggaaaattatgaggactgcagcacttattggtttctggtatccctttcggcagctactcttagcgacttgcaaattgaaatagagtatgaggaaggagtcacttttactggagagcagttatgcactctttgcatgttatctcggcaattctttgacgaccttagtaacagcgacatatttcgaatcatgacatactattgtttgcaccgttgttacgcgcagtttgctgatacaagaacttcatacagactttcttgtgaggctattggcctcatcaagatagctggattccatcgggaagaaacctatgaattccttcccttcggtgaacaacaactcagaaggaaagtttactatttacttcttatgacagagagattttacgctgtatatattaagtgtgtcacgagcctagatacaacaatagcgccaccactaccagaggttgtaacagaccctcgtctttctctggaaagcttccttgaggtgattagagttttcactgtacctggaaagtgtttttatgatgctttggctactaactgtgtcgatgattcctgcaccgaagactctctaaaaaggatatggaacgaacttcataccacatcacttgatatagagccatggtcttacggatacatcgattttctgttttcgaggcattgggtcaggacactagcgtggaaactagtacttcatatgaaaggtatgcggatgaattttctttcgaatactaataacacacatataccagtcgaaattgctagagacatgttgggagacacgtttttaactccgaaaaacctgtatgatgtacatggtcctggaataccaatgaaatcattggaagtagccaatgcattggtagatatcgtaaataagtatgatcacaatatgaagttggaggcttggaatattttgtgcgatgtatctaagttcgttttctccctgaaacattgcaatcataaaatgtttcaaaggttttcaactaaatgtcagagtgctctaatcgatttgcctatctctagaccactgcgcctaaatgatgattccaaagatgaagacgacataattcct

SEQ ID NO: 164 - protein, 470 aa, Saccharomyces cerevisiae
MGIAKQSCDCCRVRRVKCDRNKPCNRCTQRNLNCTYLQPLKKRGPKSIRAGSLKKIAEVQMVSMNNNIMTAPVVCKKVPKNLIDQCLRLYHDNLYVIWPMLSYDDLHKLLEENYEDCSTYWFLVSLSAATLSDLQIEIEYEEGVTFTGEQLCTLCMLSRQFFDDLSNSDIFRIMTYYCLHRCYAQFADTRTSYRLSCEAIGLIKIAGFHREETYEFLPFGEQQLRRKVYYLLLMTERFYAVYIKCVTSLDTTIAPPLPEVVTDPRLSLESFLEVIRVFTVPGKCFYDALATNCVDDSCTEDSLKRIWNELHTTSLDIEPWSYGYIDFLFSRHWVRTLAWKLVLHMKGMRMNFLSNTNNTHIPVEIARDMLGDTFLTPKNLYDVHGPGIPMKSLEVANALVDIVNKYDHNMKLEAWNILCDVSKFVFSLKHCNHKMFQRFSTKCQSALIDLPISRPLRLNDDSKDEDDIIP

SEQ ID NO: 165 - DNA, 1404 bp, Saccharomyces cerevisiae
atgactttagtcaagtatgcatgcgactattgtcgtgtccgtcgagtaaagtgtgatggtaaaaaaccatgtagtcgctgtattgagcacaatttcgattgcacatatcagcaaccattaaaaaaaagaggctcaaagcctattggaactagaagcttaaagtatataccaaaggccaaaatgtttatagataataaaagttgtacggcagcggcagaaatattaatgaaggttcctaaaaaggtgattgatcagtgtttgaggctttatcacgacaatctatatgttatctggcctttactctcttatgatgaccttcacaagcttttggacgaagaatacaatgaccattacgtttattggtttctcgtagctctttcagcagccaatcttagcgatctacaaagcgaattagaatctgaggggggattttcgtttactggaaaacaattagccgttctctgtatgtcctcacgccaacaatttgatgaccttagcggcagagacattttccgaattatgacatattattgcttgctacgttgtttttcacagtcttctgatgtaagaaattcatacagactttgtcgtgaagctattggccttgttattgtagcagggttacatcgtgaaaaagcatacgaatcactatcatttcgtgagcaacagcttttacgcaaggtgtattatttgcttctcttgacggaaagatactattccgtatatgttcattgtgttacaagtttggataccacaatagctccacctcagccagagttcgtaacggaccctcgactttctttggatagcttttttgagatgattagagtatttactgtaccaggtaaatgcttttttgatgctttggctacggagtctactagcggttcttgcactgaagactcactgaaaaaaatatggaaagagcttcacacagcatcccttgaaatagaaccatggtcttatggctatgtggacatttcattttctcgacattggattagggcgctggcttggaagctagtgtttcagatgaatggtaccaagtttttctcaaacgccaataatgctcacatattggtcgaaattgcaaaggatatgctggacgacatattcttaactccaaacaacctgtatgatgtacatggtcctggaataccaatgaaatcattggaagtagccaatgcattggtagatatcgtaaataagtatgatcacaatatgaagttggaggcttggaatattttgtgcgatgtatccaagttcgttttctccctgaaacattgcaatcataaaatgtttcaaaggttttcaactaaatgtcagagtgctctaatcgatttgcctatctctagaccactgcgcctaaatgatgattccaaagatgaagacgacataattcct

SEQ ID NO: 166 - protein, 468 aa, Saccharomyces cerevisiae
MTLVKYACDYCRVRRVKCDGKKPCSRCIEHNFDCTYQQPLKKRGSKPIGTRSLKYIPKAKMFIDNKSCTAAAEILMKVPKKVIDQCLRLYHDNLYVIWPLLSYDDLHKLLDEEYNDHYVYWFLVALSAANLSDLQSELESEGGFSFTGKQLAVLCMSSRQQFDDLSGRDIFRIMTYYCLLRCFSQSSDVRNSYRLCREAIGLVIVAGLHREKAYESLSFREQQLLRKVYYLLLLTERYYSVYVHCVTSLDTTIAPPQPEFVTDPRLSLDSFFEMIRVFTVPGKCFFDALATESTSGSCTEDSLKKIWKELHTASLEIEPWSYGYVDISFSRHWIRALAWKLVFQMNGTKFFSNANNAHILVEIAKDMLDDIFLTPNNLYDVHGPGIPMKSLEVANALVDIVNKYDHNMKLEAWNILCDVSKFVFSLKHCNHKMFQRFSTKCQSALIDLPISRPLRLNDDSKDEDDIIP

SEQ ID NO: 167 - DNA, 1410 bp, Saccharomyces cerevisiae
atgggtattgcgaaacagtcttgcgactgctgtcgcgttcgtcgagtaaagtgtgacaggaataaaccatgtaatcgctgcattcagcgcaatttgaactgcacttatcttcaaccgttgaaaaagagaggtccaaaatccattagagcaggaagcttaaaaaaaatagcggaagtgcagatggtgagtatgaataataatattatggccgctccggtggtatgtaagaaggttccgaaaaacctgattgatcaatgtttgaggttgtatcatgataacttatatgtaatttggccaatgctttcctacgatgatcttcacaagcttctagaagagaaatacgatgaccgttgcgcctactggtttctggtatccctttcggcagctactcttagcgacttgcaaattgaaatagagtatgaggaaggagtcacttttactggagagcagttgtgcactctttgcatgttatctcggcaattctttgacgaccttagtaacagcgacatatttcgaatcatgacatactattgtttgcaccgttgttacgcgcagtttgcggatacgagaacttcatatagactttcttgtgaagccgtgggcctcatcaagatagctggattccatcgggaagaaacctatgaattccttcccttcggtgaacaacaactcagaaggaaagtttactatttacttcttatgacagagagattttacgctgtatatattaagtgtgtcacgagcctagatgcaacaatagcgccaccactaccagaggttgtaacagaccctcgtctttctctagaaagcttccttgaggtgattagggttttcactgtaccaggaaagtgtttttatgatgctttggctactaactgtgtcgatgattcctgcaccgaagactctctaaaaaggatatggaacgaacttcataccacatcacttgatatagagccatggtcttacggatacatcgattttctgttttcgaggcattgggtcaggacactagcgtggaaactagtacttcatatgaaaggcatgcggatgaattttctttctagtgctagtagtacacatataccagtaaaaattgctagagacatgttgggagacacgttcttaactccgaaaaacctgtatgatgtacatggtcctggaataccgatgaaggcattagaaatagccaatgcattggtagatgtcgtaaataagtatgatcacaatatgaagttggaagcttggaatgttttgtatgatgtatccaagtttgttttttctctgaaacattgcaataataaaatgttcgacagattttcaacgaaatgtcaaggtgccctaattactctgcccatttctaaacctttgcaattaaatgataactccaaagatgaagacgacataattcct

SEQ ID NO: 168 - protein, 470 aa, Saccharomyces cerevisiae
MGIAKQSCDCCRVRRVKCDRNKPCNRCIQRNLNCTYLQPLKKRGPKSIRAGSLKKIAEVQMVSMNNNIMAAPVVCKKVPKNLIDQCLRLYHDNLYVIWPMLSYDDLHKLLEEKYDDRCAYWFLVSLSAATLSDLQIEIEYEEGVTFTGEQLCTLCMLSRQFFDDLSNSDIFRIMTYYCLHRCYAQFADTRTSYRLSCEAVGLIKIAGFHREETYEFLPFGEQQLRRKVYYLLLMTERFYAVYIKCVTSLDATIAPPLPEVVTDPRLSLESFLEVIRVFTVPGKCFYDALATNCVDDSCTEDSLKRIWNELHTTSLDIEPWSYGYIDFLFSRHWVRTLAWKLVLHMKGMRMNFLSSASSTHIPVKIARDMLGDTFLTPKNLYDVHGPGIPMKALEIANALVDVVNKYDHNMKLEAWNVLYDVSKFVFSLKHCNNKMFDRFSTKCQGALITLPISKPLQLNDNSKDEDDIIP

SEQ ID NO: 169 - DNA, 1419 bp, Saccharomyces carlsbergensis
atgggtattgcgaaacagtcttgcgactgctgtcgcgttcgtcgagtaaagtgtgacaggaataaaccatgtaatcgctgcattcagcgcaatttgaactgcacttatcttcaaccgttgaaaaagagaggtccaaaatccattagagcaggaagcttaaaaaaaatagcggaagtgcagatggtgagtatgaataataatattatggccgctccggtggtatgtaagaaggttccgaaaaacctgattgatcaatgtttgaggttgaggttgtatcatgataacttatatgtaatttggccaatgctttcctacgatgatcttcacaagcttctagaagagaaatacgatgaccgttgcgcctactggtttctggtatccctttcggcagctactcttagcgacttgcaaattgaaatagagtatgaggaaggagtcacttttactggagagcagttgtgcactctttgcatgttatctcggcaattctttgacgaccttagtaacagcgacatatttcgaatcatgacatactattgtttgcaccgttgttacgcgcagtttgcggatacgagaacttcatatagactttcttgtgaagccgtgggcctcatcatcaagatagctggattccatcgggaagaaacctatgaattccttcccttcggtgaacaacaactcagaaggaaagtttactatttacttcttatgacagagagattttacgctgtatatattaagtgtgtcacgagcctagatgcaacaatagcgccaccactaccagaggttgtaacagaccctcgtctttctctagaaagcttccttgaggtgattagagttttcactataccaggaaagtgtttttatgatgctttggctactaactgtgtcgatgattcctgcaccgaagactctctaaaaaggatacggaacgaacttcataccacatcacttgatatagagccatggtcttacggatacatcgattttctattttcgaggcattgggtcaggacactagcgtggaaactagtacttcatatgaaaggtatgcggatgaattttctttcgaatactaataacacacatataccagtcgaaattgctagagacatgttgggagacacgtttttaactccgaaaaacctgtatgatgtacatggtcctggaataccgatgaaggcattagaaatagccaatgcattggtagatgtcgtaaataagtatgatcacaatatgaagttggaagcttggaatgttttgtatgatgtatccaagtttgttttttctctgaaacattgcaataataaaatgttcgacagattttcaacgaaatgtcaaggtgccctaattactctgcccatttctaaacctttgcaattaaatgataactccaaagatgaagacgacataattcct

SEQ ID NO: 170 - protein, 473 aa, Saccharomyces carlsbergensis
MGIAKQSCDCCRVRRVKCDRNKPCNRCIQRNLNCTYLQPLKKRGPKSIRAGSLKKIAEVQMVSMNNNIMAAPVVCKKVPKNLIDQCLRLRLYHDNLYVIWPMLSYDDLHKLLEEKYDDRCAYWFLVSLSAATLSDLQIEIEYEEGVTFTGEQLCTLCMLSRQFFDDLSNSDIFRIMTYYCLHRCYAQFADTRTSYRLSCEAVGLIIKIAGFHREETYEFLPFGEQQLRRKVYYLLLMTERFYAVYIKCVTSLDATIAPPLPEVVTDPRLSLESFLEVIRVFTIPGKCFYDALATNCVDDSCTEDSLKRIRNELHTTSLDIEPWSYGYIDFLFSRHWVRTLAWKLVLHMKGMRMNFLSNTNNTHIPVEIARDMLGDTFLTPKNLYDVHGPGIPMKALEIANALVDVVNKYDHNMKLEAWNVLYDVSKFVFSLKHCNNKMFDRFSTKCQGALITLPISKPLQLNDNSKDEDDIIP

SEQ ID NO: 171 - DNA, 4287 bp, Saccharomyces cerevisiae
atggcaaataataattctgatcgacaaggtttggaacccagagtcattagaactctgggttcacaagcgcttagcggtcctagcatatctaatagaacttcaagttcggaggcaaaccctcatttttccaagaacgtgaaggaagcaatgatcaagacagcttctccgactcctttatctacacctatttacaggatagctcaagcttgtgacaggtgtcgatctaagaaaacaaggtgcgatggaaaaagaccacagtgttcgcagtgtgctgctgtcggatttgaatgcagaataagcgataaattactgaggaaagcgtatccaaaagggtacacagaaagcctggaagaaagagtacgcgaactggaggcagagaataagcgtttgctagctttgtgtgatatcaaagaacagcaaataagccttgtttcacagtcgcgaccacagacatcaacggataataccataaatggcaatttcaaacatgatttgaaagatgctccattgaatctgtcttctacaaatatctatttattaaatcaaacggttaataagcagctacaaaatggcaaaatggatggtgataatagcggttctgcaatgagtccattgggggcaccacctccaccgccacacaaagaccatctttgtgacggcgtttcctgtacaaatcatttacacgtcaagcctacttctacgagtttaaacgatccaaccgctatatcttttgaacaggacgaggcacctggtcttcctgcggtaaaggcattaaaatcaatgacgactcatcaacgtagcactcaattggcaactttagtttctttatccatcccaagatctactgaagaaattctgtttattcctcagcttttaactaggataagacaaatatttggtttcaacgcaaagcaatgtttgtatacggtttcattattatcttcattgaaaaatcgcttgccagcaccacggcttctagcaccttcaacatcaaccaagttaaaggagaaagatgaagataaaaaacttgatgatgattcggcttttgtgaaaaggtttcaaagcacaaacctctccgagtttgtcgatttgaaaaagtttttaatttctttgaaatttaacattaactcgttttcaaagcaatcagaaaagccggctaatgatcaggatgatgaactactttccctcactgaaattaaagagcttttacacctttttttcaaattttggtctaatcaggtaccaattctaaacaatgaccacttcttaatatatttcaacaattttgttgaagtcgtgaagcatttatctacagaaaatttggagacgaataacactactaaaagtacagtcaccactaatcatgaaatatttgccctaaagcttctgatgatgttacaaatggggttactcgttaagattaaaatggaaaaaataaaatacactgtaccgaagaatccgaaggccaaatatgctagattgatggcatattatcatcagctttccctaataattcctaaaaatccttattttttaaatatgtccacaacttcattaccatccttacaattgttatctttggcatccttttattatttaaacgtgggtgatatttcggcaatctatggggtaagaggccgtattgtttctatggcacaacaattgagacttcacagatgtcctagtgccgtattaagtgtacactctaacccagttctacaaaaatttgagcaaagcgagaggagattactgttttgggcaatttattacgttgacgtttttgcctcattgcaacttggtgttcctcgtttacttaaggattttgatattgaatgtgcattaccaatttctgatgttgagtataaggatcagttatctatggaaaatgaaaaagcagataaaaaagctaaaaagattcaactgcaaggtcaagtttcaagcttttcattgcagataatcagatttgcgaaaatattaggtaacattctagactcgatttttaagagaggaatgatggatgaacgtataacttctgaagttgcattagtacatgaaaacgcactggataactggagaaatcaacttcccgaaatgtactactttcaaataactgtaaacggaactgtgaatttagacgagattagagcaaccaatcaaagaaatactgagaccaaatttgataagaaagacataatattatttgaaaagaagattctattactgttttatttcttggccaaatctatgatacatttaccggttattgcaaccaaacctttgcctaagaatgtagataatgccgcaaagaagaaacagtcaatgttcaacaacgactctaaaggcgcaaccaaccaggaccacatgatattagatgttgatatgacttctcctgctataaggacgtcatcctcatatatcattttacaacaagctaccaatgcaacgcttacgattttccaggccattaattccatgtatttacctttgccattgaatgtatcaagaacgttaatcagattttctttgctctgtgctagaggttctttggaatataccaaaggtggtgcgttattcttagataataaaaatcttctcctcgacaccatcaaagatatcgaaaacgataggcttttggatttacctggaattgcctcttggcacacgctgaaactgtttgacatgagcatcaacctgttgttgaaagcacctaatgttaaggttgaaagactggataaattcttggaaaagaaattgaattactacaatagattgatggggttaccaccggccacaaccacatccttaaaaccactatttggctctcaatcgaagaacagcctggaaaatagacaaagaacacctaatgtcaaaagagaaaacccagaacacgagtatctttatggaaacgatagtaataataacaataattctgaagcgggtcactcgccaatgacaaatacaactaatggtaataagagattaaagtatgaaaaaaatgcaaaagatggcagtatatccaagggggaaaacgcacagaatttcccgaatgataccaaaaaaaacatgtccaccagcaatctgtttccattctcgtttagtaatacagaccttactgcgctgttcacccatcctgaaggaccgaattgtacgaatactaataatggcaacatggatgtgtgcaacagagcttctacagatgccgcggattccaatatagagaatttaagctttttaaatatggcaccattcttacagaccggtagctccaatataggtcaaaacacggttgagaataagcctatgcacatggatgcgatattcagcctaccaagtaatttagatctattgaaggacaatatggactctaaaccggaacaattagaacccgttattaagcaaaaccctgagaattcaaaaaataaccaatttcatcagaaaggaaaaagtacgaatatggaaaagaataatcttgctttcaacaacaagagtaactacagcctaacaaagctaatgagattgctgaacaacgataattctttctcgaatattagtattaacaactttttatatcaaaatgatcagaactccgcgtcagcggatccgggaacaaataaaaaagccgttacaaatgcaggtgccaacttcaaaccaccttcaactggcagtaataccagccaaggcagtatccttggaagtacaaagcatggaatggacaactgtgatttcaacgatttaggtaattttaacaatttcatgacaaatgtcaattattctggggtcgactatgattacattgtagacgcatcacttgggttggctcctttattagtggatacgcccgatatctcaaataccaacacgacgtctactacgtcaaatcgaagtaaaaacagcatcatcctagatacgacatttaacgatgacttggatcggtcgcgcatgaatgccagagaagtattgaaccctaccgactcaattttaagtcaaggaatggtatcctccgtaagtacgagaaataccagcaatcaaagatctctttcatcgggtaatgattcaaaaggtgacagtagttctcaagagaactcaaagagtgcaactggcaaccagttggatacaccttctacactgtttcaaatgagaaggacctcttcagggccctcggcgtcccaccgtggtccaagacggcctcagaaaaatcgttacaatacagatcgatcaaaaagttccggtggcggaagttccaacacagataatgtatctgatttattccaatggcaaaacgccaaa

SEQ ID NO: 172 - protein, 1429 aa, Saccharomyces cerevisiae
MANNNSDRQGLEPRVIRTLGSQALSGPSISNRTSSSEANPHFSKNVKEAMIKTASPTPLSTPIYRIAQACDRCRSKKTRCDGKRPQCSQCAAVGFECRISDKLLRKAYPKGYTESLEERVRELEAENKRLLALCDIKEQQISLVSQSRPQTSTDNTINGNFKHDLKDAPLNLSSTNIYLLNQTVNKQLQNGKMDGDNSGSAMSPLGAPPPPPHKDHLCDGVSCTNHLHVKPTSTSLNDPTAISFEQDEAPGLPAVKALKSMTTHQRSTQLATLVSLSIPRSTEEILFIPQLLTRIRQIFGFNAKQCLYTVSLLSSLKNRLPAPRLLAPSTSTKLKEKDEDKKLDDDSAFVKRFQSTNLSEFVDLKKFLISLKFNINSFSKQSEKPANDQDDELLSLTEIKELLHLFFKFWSNQVPILNNDHFLIYFNNFVEVVKHLSTENLETNNTTKSTVTTNHEIFALKLLMMLQMGLLVKIKMEKIKYTVPKNPKAKYARLMAYYHQLSLIIPKNPYFLNMSTTSLPSLQLLSLASFYYLNVGDISAIYGVRGRIVSMAQQLRLHRCPSAVLSVHSNPVLQKFEQSERRLLFWAIYYVDVFASLQLGVPRLLKDFDIECALPISDVEYKDQLSMENEKADKKAKKIQLQGQVSSFSLQIIRFAKILGNILDSIFKRGMMDERITSEVALVHENALDNWRNQLPEMYYFQITVNGTVNLDEIRATNQRNTETKFDKKDIILFEKKILLLFYFLAKSMIHLPVIATKPLPKNVDNAAKKKQSMFNNDSKGATNQDHMILDVDMTSPAIRTSSSYIILQQATNATLTIFQAINSMYLPLPLNVSRTLIRFSLLCARGSLEYTKGGALFLDNKNLLLDTIKDIENDRLLDLPGIASWHTLKLFDMSINLLLKAPNVKVERLDKFLEKKLNYYNRLMGLPPATTTSLKPLFGSQSKNSLENRQRTPNVKRENPEHEYLYGNDSNNNNNSEAGHSPMTNTTNGNKRLKYEKNAKDGSISKGENAQNFPNDTKKNMSTSNLFPFSFSNTDLTALFTHPEGPNCTNTNNGNMDVCNRASTDAADSNIENLSFLNMAPFLQTGSSNIGQNTVENKPMHMDAIFSLPSNLDLLKDNMDSKPEQLEPVIKQNPENSKNNQFHQKGKSTNMEKNNLAFNNKSNYSLTKLMRLLNNDNSFSNISINNFLYQNDQNSASADPGTNKKAVTNAGANFKPPSTGSNTSQGSILGSTKHGMDNCDFNDLGNFNNFMTNVNYSGVDYDYIVDASLGLAPLLVDTPDISNTNTTSTTSNRSKNSIILDTTFNDDLDRSRMNAREVLNPTDSILSQGMVSSVSTRNTSNQRSLSSGNDSKGDSSSQENSKSATGNQLDTPSTLFQMRRTSSGPSASHRGPRRPQKNRYNTDRSKSSGGGSSNTDNVSDLFQWQNAK

SEQ ID NO: 173 - DNA, 2676 bp, Aspergillus nidulans
atgggggaaaagctcgacccggaactctcttccgacggacctcacacgaagtcgtcgtccaagggtcaagggaccagtacggacaatgctccagcgtcgaagcgacgttgtgtgagcacagcgtgcattgcttgccgcaggcggaaatcaaagtgtgatggaaatcttccaagttgcgccgcctgctcctccgtctatcatacaacctgcgtttatgatccaaactccgaccaccggcgaaaaggagtttacaagaaggatacggacacgttaagaactaagaactctaccttgttaactttgattcaggcgctgctcaactatgaggaggaagatgccttcgacctggtccgccaaatccggtcctgtgataacctggaagacgtagcgcaatctctcgtaaaccaggaaaagaagtcgtctggttggctgtcaaatgcggtaatacatgaagagaacgatatcgcgcagacggatcaattcgagtctgaattggctggaaagatgagcaacctcgtgctagacggatcccgcaagtttattggcgggacgtcaaacctcatcttcctaccacccggatcggaactcaacgagttcaagcctggcttggctactaacggcgatctggagggatccgtcacccggtggacgacagttactgatgatcagcagcttattagccatctcttgacaatgtacttttcatggcattatcctttcttcaccactctgtccaaggaactcttctaccgtgattactctcgtggagtgccgagccagtattgctcttccttgcttgttaacacgatgctggccttggggtgtcacttcagctcctggccaggggcccgtgaagatccagacaactctgctaccgccggtgatcactttttcaaagaagcgaagagattgatccttgacaacgacgagcttgtcaactcaaagctttgcaccgtgcaagctctggctcttatgtccgtacgagaggccggatgtggccgtgaagggaaaggctgggtttatagcggaatgagtttccgcatggcatttgacttgggcttgaatcttgagtcttcgagcttacgagatctcagcgaagaagagatagatgcaagacgcatcactttttggggttgtttcctcttcgacaaatgttggtctaattatcttggacggcagcctcagttcacgacagcgaacacaagtgtttccgcagtggatattctacccaacgaagaatcaacattatggtctccttacagtgatatggggcctagtcgggagtatgcacaaccttcgcggacaagggcagtcgcagaccagatttcccaattgtgtaagatcagtggagatctagtggtgtttttctacgaccttgctcccaaagaaaagccatcgtccaagcaactggagctaaagaagctaagtgagattcatactcgcttagaagcgtggaagaaaggcttgccgaaggaactcgagccgcgcgaaggccagcttccgcaggcgctactcatgcacatgttctaccaacttctcctcattcacctttaccgccccttcctcaaatacacaaagtcgacctccccgcttcctcagcatgtctctccccgcaagctatgcactcaggcggcagctgctatatcgaagttactacggctttataaacgcacatacgggtttaagcagatctgcaatatcgccgtttatattgcgcatacagccttgacaatccaccttctcaatctacccgaaaagaatgcacagagagatgtaatacacggcctgagacatctcgaagagatgggagagtcttggctttgtgctcgccggacgcttcgtattctcgacatatctgccagtaagtggcaggtacaactaccgagggaggccgttatcgtcttcgaacaaacacatgctcgatggggctcgtggggcccttgggaccaagcagcatcgccttcaacaacctcggattcaccgccatccgtcagctcccagtccgtggttgccaccacggatctatcccaacctgtatcccagtctgcgggcaatcagcctgccaatccttctatgggtacgtctccgaacctaacacagcccgtagcctctcaatattcttccacgccttctggacctgtctctgtatctgcaatgcgtgctgttcaacgatctttcagtgctcaacttgcacacaacgaagcccgacaacctgaacctacgtatctaagaccggtctctaccagctatggaccagttccgtcaactcagtctgcacaagagcagtggtacagcccaactgaggcacaattccgcgcatttactgctgctcacagtatgcctacaacatcagcccaatctccgttgaccacctttgatacaccagaaaatctggttgaggaaagtcaggactggtggtctcgcgacgttaatgcactacaactcggggccgaggactggactcagaattggaataatggtctccccaccacatcggccgactggcgctatgtggacaatgtccccaacatcccttctacatctgcgcccgatgccgattacaagcctccacaaccacctcccaacatggcaagaccgaatcaatatccaactgaccctgttgcgaacgtgaacagcaaccaaaccaacatgattttccccggcagttttcagcga

SEQ ID NO: 174 - protein, 892 aa, Aspergillus nidulans
MGEKLDPELSSDGPHTKSSSKGQGTSTDNAPASKRRCVSTACIACRRRKSKCDGNLPSCAACSSVYHTTCVYDPNSDHRRKGVYKKDTDTLRTKNSTLLTLIQALLNYEEEDAFDLVRQIRSCDNLEDVAQSLVNQEKKSSGWLSNAVIHEENDIAQTDQFESELAGKMSNLVLDGSRKFIGGTSNLIFLPPGSELNEFKPGLATNGDLEGSVTRWTTVTDDQQLISHLLTMYFSWHYPFFTTLSKELFYRDYSRGVPSQYCSSLLVNTMLALGCHFSSWPGAREDPDNSATAGDHFFKEAKRLILDNDELVNSKLCTVQALALMSVREAGCGREGKGWVYSGMSFRMAFDLGLNLESSSLRDLSEEEIDARRITFWGCFLFDKCWSNYLGRQPQFTTANTSVSAVDILPNEESTLWSPYSDMGPSREYAQPSRTRAVADQISQLCKISGDLVVFFYDLAPKEKPSSKQLELKKLSEIHTRLEAWKKGLPKELEPREGQLPQALLMHMFYQLLLIHLYRPFLKYTKSTSPLPQHVSPRKLCTQAAAAISKLLRLYKRTYGFKQICNIAVYIAHTALTIHLLNLPEKNAQRDVIHGLRHLEEMGESWLCARRTLRILDISASKWQVQLPREAVIVFEQTHARWGSWGPWDQAASPSTTSDSPPSVSSQSVVATTDLSQPVSQSAGNQPANPSMGTSPNLTQPVASQYSSTPSGPVSVSAMRAVQRSFSAQLAHNEARQPEPTYLRPVSTSYGPVPSTQSAQEQWYSPTEAQFRAFTAAHSMPTTSAQSPLTTFDTPENLVEESQDWWSRDVNALQLGAEDWTQNWNNGLPTTSADWRYVDNVPNIPSTSAPDADYKPPQPPPNMARPNQYPTDPVANVNSNQTNMIFPGSFQR

SEQ ID NO: 175 - DNA, 3265 bp, Neurospora crassa
cagttcggatgttcaaatgatgtcctctcaagatgcgccaggctcagccggactcgcccccgacaacatcgcctcttcgttaccttccaagaagaagtctaggcggggcgctgaccctaccaaccaaaagcgacgatgtgtgagcacggcctgcatcgcctgtcggaggaggaagtccaagtgtgacggcgcccttccgagctgcgcggcctgtgccagtgtctacggcaccgagtgcatctatgacccaaattcagatcaccgccgaaaaggcgtctaccgggagaagaacgatagcatgaaagcccagaacgccacactgcagatcctaatagaggccattttgaatgcttccgaggaagatgtgatcgacattgtgaggaggattcgcacctgtgacgaccttgacgaagtagccgagtccatccgcagggatgagaagaacgcaacagcaaccaacgacaacgatgacagcgatgaacccacccaacctggcagagatgacgctaccagtcaggccgttgagggtgagagggacttggcccgtaagatgggagagctccggatcgaaaatggttctgttcgttttattggcggtacctcgcacctcatatatctcagtgaaccgacagatgcctctgaagaaccggagcttgaaacccgcctgtcgacctgcgatgagaatccaatcaccacctggacagaggtgaccaagaatcctcaactaatcatccatctcgtcaacatgtatttcaactggcactatccttacttcaccacgctgtctagaagcttgttttatcgggatttcatcaagggaaacgcggctggccaaccacgctccactgtttactgttcgtcgctgctggtcaatgccatgctcgcgcttggctgtcacttcacaagtgtggacggtgcctttgcggtacctggggacagcaggaccaagggtgatcacttcttcgccgaggccaagagactgattgttcagaacgacgagtacgaaaaaccaaggctcactaccgtgcaagctctggcgcttatgtcagtgcgagaagcaggctgcggacgggaagcgaaaggctgggtatacagcggcatgagcttcagaatggctcaagacattggcctgaatctagacattggatcgctggacgaaaaggaggtggatgcccggagaatcaccttttggggttgctttgtgtttgacaagtgctggtcaaactatctcgggcggctaccacagcttcccaaaaacacctataacgttccgaagtatgatgtgtttccagacgaagatgctgaactgtggtctccttataccgacgcaggcttcgaccagtcttgcaagcagccatctcggacacgggctataggcttacagttgtcgaaatcctgcgagatcagtagtgatcttttactcttcttctaccaccccagtcatattggaagatcgagcggcaagtcagctgagctcaaaaagcttagcgaacttcatcggcgtctggaagactggagaacggagctaccaaaggaattcgaacccaaggatggccagttacccaatgtcattctaatgcacatgttttatcatctacagtatatccatctattccgacccttcctaaagtacacaaaggaagcttcgcccctggagaaggtccagccccgaagaatatgcacaactaacgccaatagcatatccaaacttatgcgactttacaaaaagctatataacctccggcaaatatgtaacattgccgtatacatgctgcattctgcgtgcacaatacacatgctcaatttgcccgagaaaactgccagacgggatataacccacggcgttagacagttggaggaaatggctgaagactggccttgtgcgcggagaacattaggtatcatcagcgttctagctcggaagtggaatgtggaactacccgaggaggccgccattgtcttgaagaggacagacgaaaagtacggaatgtttagcacttccgaggtcccctcacccaacaggacggccccttctctcgctccatcctcgcctgcacctccttacaccccagaagcgtctctgcttttttctacaacagccgccgcagtactcgaacaacaaccgtacagtccaatgacactatatagccacccaactcctccgcatcttggtccggagagtatatctgatcccggaatgtcgcctaatatagtcaccttctccgacctgcctgatccgtccgctcccatcatcccccagcaacagcagaacatgcaggctatatctagcttaagccaaaacaatatgcttcaccaacaccaccaccacctacaaaaccaacatcaacctcaacagccacaccataaccacatgacctaccagcagcaacaacataacctgctcacccacccggtgagcgcctcatcaatgtccatgagcgacactctcgccaccattacggcatggggtataccaacctcttcacccggcaacaacaataacaataacatcgtatcccaacatccgcatcatcaaaagcagccacaacagcaacaacaaccacaagcacaacgatatcccacagttggatcagtcggcacaaacaccgtgaaacctccagcagctgccacgcagacctttactccagcccagttacacgcgaataacttggcgactgcaacgagatcaacagcttccaaccacaagagcgttggccgacacgtaagccccagctcgatctacgccattgatggacaggattggtacctgaaggatggcgtcacctggcaacagggctttcaggggtgggatctggagggcggtggagcaggcacagctacaagcactggtggtattggggatgggggtggacctactggtggtgctggtgatagcatggcgaggctagctcctcgagggaatattggcggcggcggcggcggcggcggcggtagtacaggacagcgacagcaacagcaacagcgacagcaacagcaacagcaacagcaacagcaacagcaacagcaacagcaacagcaacagcaacagcaacagcaacagcagcaagaggctaatatgtttgcgtatcatcatggggcagagagaggggggggtggtatagaatcaacgggcatgggaatgacgacggtaggaggtggaggaggagggttcgatccaataggaggatctgggctattggatgatttggtgggtctggatgaattgggcagcttggacggcttgggacatctcccaggtctagat

SEQ ID NO: 176 - protein, 1090 aa, Neurospora crassa
MNSSDVQMMSSQDAPGSAGLAPDNIASSLPSKKKSRRGADPTNQKRRCVSTACIACRRRKSKCDGALPSCAACASVYGTECIYDPNSDHRRKGVYREKNDSMKAQNATLQILIEAILNASEEDVIDIVRRIRTCDDLDEVAESIRRDEKNATATNDNDDSDEPTQPGRDDATSQAVEGERDLARKMGELRIENGSVRFIGGTSHLIYLSEPTDASEEPELETRLSTCDENPITTWTEVTKNPQLIIHLVNMYFNWHYPYFTTLSRSLFYRDFIKGNAAGQPRSTVYCSSLLVNAMLALGCHFTSVDGAFAVPGDSRTKGDHFFAEAKRLIVQNDEYEKPRLTTVQALALMSVREAGCGREAKGWVYSGMSFRMAQDIGLNLDIGSLDEKEVDARRITFWGCFVFDKCWSNYLGRLPQLPKNTYNVPKYDVFPDEDAELWSPYTDAGFDQSCKQPSRTRAIGLQLSKLCEISSDLLLFFYHPSHIGRSSGKSAELKKLSELHRRLEDWRTELPKEFEPKDGQLPNVILMHMFYHLQYIHLFRPFLKYTKEASPLEKVQPRRICTTNANSISKLMRLYKKLYNLRQICNIAVYMLHSACTIHMLNLPEKTARRDITHGVRQLEEMAEDWPCARRTLGIISVLARKWNVELPEEAAIVLKRTDEKYGMFSTSEVPSPNRTAPSLAPSSPAPPYTPEASLLFSTTAAAVLEQQPYSPMTLYSHPTPPHLGPESISDPGMSPNIVTFSDLPDPSAPIIPQQQQNMQAISSLSQNNMLHQHHHHLQNQHQPQQPHHNHMTYQQQQHNLLTHPVSASSMSMSDTLATITAWGIPTSSPGNNNNNNIVSQHPHHQKQPQQQQQPQAQRYPTVGSVGTNTVKPPAAATQTFTPAQLHANNLATATRSTASNHKSVGRHVSPSSIYAIDGQDWYLKDGVTWQQGFQGWDLEGGGAGTATSTGGIGDGGGPTGGAGDSMARLAPRGNIGGGGGGGGGSTGQRQQQQQRQQQQQQQQQQQQQQQQQQQQQQQQQQQEANMFAYHHGAERGGGGIESTGMGMTTVGGGGGGFDPIGGSGLLDDLVGLDELGSLDGLGHLPGLD

SEQ ID NO: 177 - DNA, 2325 bp, Schizosaccharomyces pombe
atgaatgaagaaataggatttttaaaaaatcaactttttgccgatgttaaagatttggagcgaaaaaagaaaaggcgggtacctccagagcagcgacgacgtgtgtttcgagcatgtaagcattgccgccagaaaaagattaaatgtaatggtggtcagccatgcataagttgcaaaacgttaaatatcgagtgtgtttatgcacaaaaatcacagaataaaacattgtcgcgtgaatacctagaagagttatcagaaagacaactatgtttggaatacattttctctcgaatgtgcccaaatttcaacctcgaaaccaaaaatttaatttcgatatccaaaaagttatctgaaaacgaaaacttgcctgtgtcaaaaatagctgaagttacaaatgagctagacacattagtacgaattaatgatcagctaagcagaaatcatataagtggaactacggaagaaatgcaatcatcatcttccttaattgcaggtgaggtacagccaggcatttcgttcagagatcaactcaaagtagggaaacttgaagatacgctttatcttggaccaacaacctctgaggcgtttattgaacgtttgcaaaacgaattggagcttgaatcaatttctgaagacgatttgtattccaagcgtttatcaccttccgtctcatattccgaatttgatgaacaattacttttacatgcaagaagcttgatcccttccaaagctgtggttgaatttttaatcaattctttttttatcaacgtccaaaccaatttgtttgtttatcatccccattttttcaaatgtagattagagatttttttagcgatggaaaaccaaattgatgctggatttttgtgcattctacttatggttcttgcttttggcaatcagtatacggcagaacaacaggaagatgtcagcaagtcgaattttcatgcctccaacattggtaacagattattttcagctgcgctgagcatttttccactcgtccttttacaatcagacgttagtgcagttcaatcttccctacttattggtctgtatcttcaatctaccatttatgaaaaatctagttttgcatattttggtttggcgatcaaatttgcggttgccctaggacttcacaaaaactctgatgatccttctcttacccaaaattccaaggaattgagaaaccgattgttgtggtcagttttctgtattgaccgttttgtaagcatgactactggaagacgccctagcatacctttggaatgcatttctataccttaccctgttatattgcccgatttagaaataccgggttctcagtctatcgtcgaaaacatgcgtgccgttattaacttggctaagttaacaaatgagatttgcgattcgctgtactggaacccttctccaagctttgaatcgcaagttaattctgtccgtaggatttatgctcgtctagagctttggaaaagtgatttacattcttctgtggtttttgatgaatcggctgttcagcatccactcttccggtcaaatgcacatgttcaaatgatatatgataatgcgattatgcttactacgagagttattatggtaaagaaattaaaagataaagatttaactgctgaaaatcgtcgctacatccagctatgtgttgaaagcgcaacaagggtcataaacatagcacatcttttattaacacataagtgtttgtccagcttatcgtttttcgggctgcatgttccatttgcaagcgcacctattttactcttgtctcttcattacgaaaactctcaggatattcaagctgtagtcacaaaattatggcaggtattggaatttctgagttcaaggtgtgaatttgctagagaaagtctaaactaccttaagtcatttaacaaacagttatctaggcgcaatgccccagacattaataatccgattgcagatttccaaaatagttttcaaaattggcaatcctgggtgggagatatgtcacatggagacatgctttctacctttaagcttacaggagaaagctcaaatggtagtaatagtactccaaacgaagcattccaaccttttgaccaaacatcatctctctataatgttccgggtctaaacaaaagttatgttagtaaccaacccagtttgctcacacctgaaacttttctaccggatccagttctcaatttggaagttgataaacaatggacggctcctacgtttttgagttggacggaactgctaggccctactaatgtctctgagcagtcttcgcatactgcagagcaaacttcaaatttgacccttgaaaaaaatgga

SEQ ID NO: 178 - protein, 775 aa, Schizosaccharomyces pombe
MNEEIGFLKNQLFADVKDLERKKKRRVPPEQRRRVFRACKHCRQKKIKCNGGQPCISCKTLNIECVYAQKSQNKTLSREYLEELSERQLCLEYIFSRMCPNFNLETKNLISISKKLSENENLPVSKIAEVTNELDTLVRINDQLSRNHISGTTEEMQSSSSLIAGEVQPGISFRDQLKVGKLEDTLYLGPTTSEAFIERLQNELELESISEDDLYSKRLSPSVSYSEFDEQLLLHARSLIPSKAVVEFLINSFFINVQTNLFVYHPHFFKCRLEIFLAMENQIDAGFLCILLMVLAFGNQYTAEQQEDVSKSNFHASNIGNRLFSAALSIFPLVLLQSDVSAVQSSLLIGLYLQSTIYEKSSFAYFGLAIKFAVALGLHKNSDDPSLTQNSKELRNRLLWSVFCIDRFVSMTTGRRPSIPLECISIPYPVILPDLEIPGSQSIVENMRAVINLAKLTNEICDSLYWNPSPSFESQVNSVRRIYARLELWKSDLHSSVVFDESAVQHPLFRSNAHVQMIYDNAIMLTTRVIMVKKLKDKDLTAENRRYIQLCVESATRVINIAHLLLTHKCLSSLSFFGLHVPFASAPILLLSLHYENSQDIQAVVTKLWQVLEFLSSRCEFARESLNYLKSFNKQLSRRNAPDINNPIADFQNSFQNWQSWVGDMSHGDMLSTFKLTGESSNGSNSTPNEAFQPFDQTSSLYNVPGLNKSYVSNQPSLLTPETFLPDPVLNLEVDKQWTAPTFLSWTELLGPTNVSEQSSHTAEQTSNLTLEKNG

SEQ ID NO: 179 - DNA, 3186 bp, Saccharomyces cerevisiae
atggtcgaaaatagtacgcagaaggccccacatgccggaaatgatgataatagctctaccaagccatattcggaggcgtttttcttagggttcaataacccaacgcctggattagaagctgagcactcaagcacatcgcctgcccccgagaactccgaaacacataataggaaaagaaatagaatattgtttgtctgccaggcttgttggaagtcaaaaacaaagtgtgatagagaaaaacctgaatgtggtcgatgcgtcaagcatgggttaaaatgtgtttatgacgtatcaaaacagccagcaccacgaattccgagtaaagacgccattatatcaaggttggaaaaagatatgttttattggaaagataaagctatgaagctactaacagagagagaggtgaatgaatcaggcaagagatcagcaagtccgatcaatacaaacaatgctagcggggacagtcctgataccaagaagcagcataaaatggaacctatatatgaacaaagtggtaacggggatataaacaatggtaccagaaatgatattgaaatcaacttgtatagaagtcatccaaccatgatcatgagtaaagtcatgaaaagagaagttaagccgttatctgaaaattatattataattcaggactgttttctaaaaatcctggtcacttcagtgttccttgacacttcaaagaacacgatgataccggcattgacggcaaacgcgaatattacaagagcccagcctagcgtagcaaataaccttttgaaattgaaggaaatgctaatcagacagtgtcaaaccgaagatgaaaaaaatcgtgtaaacgaattcactgatagaatactacaaaatacaaattcaaatagaaacttgaaaatcggtatgctattatcaatgctttacaattctgtcggttaccaatatctggaggatcattgccctcaaggtggcgaatattcggatttattgagaaatttgatcaatgaatgtgaagctattttgccatcttacgaaattattgaacgctacaagaaccacttttatgagtacgtttatccaagtctacctttcatcgaattagaaatttttgaagaatcattaagtcaaacaatttttccggacccaaacaacccctccaaggtgcaaatacgtatgggtagcacacatttgagagctaaggtggaaaacttgagtcttctattggttatcttgaaactctcatacatgtcaataaggtttttagatcatagtacagcagactcgagtttttatctttcaaaggaaataattgataaatacccaataccgaacgattttattttattgagtccaagatgtctagcatcggaaaattggtgtgcatgcgctaatgaaaacatcatatcatgtttactatatatctggtctttttttgctttttctcctgaagagggtgatttctttctcgagcaccccaccgatgttatcagtagtttgataatgatgctttccacctcgattggtctccacagagatccttcagatttccctcaattgatttccccgtccacctcagataaaagaaccttgaatcacagaagaatactctggttgagtatcgttaccgtttgttcgtttgaagcaagtctcaaaggtagacattctgtctcaccgatatctttaatggccttattcctaaatattaaggatcctgattctctgacggtatatatgaaccgagttaggggcgatctaagcgatatcaataatcacacacttttgagaattcataaatttacattcaagagagcccagcttgcgttactcctgtcggacttagataacttgacgatgacatactatggtagtttccatttgcattcaattgaattcataagagaaaagattgagatttttgtggaggaaaactttcccatagtaccattaaaaagtgtcgcacaggataagtcagaccttgatgacatgaatgtgatttcagaaatgaatatattatcttcagaaaattcttcttcatttcacaatcgaataatgaataaactattgatgttgagaacttcaatggccgtattcttgcattttgaaacacttatcactaaggataaaagtatcttcccattctacaagaaatactttatggttagctgtatggatgcgttgtcactaataaattatttcaataagtttttcaacggagaatatcgacacgcaatatcttctttaaccagttttaatgttacaaaatttattcagttagcactatccagcacaatcttcagcctattagggattatactaagaataggtttagccatccatatgttatcttctgaagtacaaaagttatcgggaacgacagatccaagaataaaggagttaaataccaaagtcgaaaaatttagtaccctgcaaagagatctcgagtctgctttagaaggtatatattgctctgcttcggaacatttaagattcacatacttccccgtttttaagatgttggctttattcgatgtcattgtacaaaggatgagaaagggtgaattatggcacggcatatttacgatgattcaaatggaacaaatgcattctaggataatcaagacattaagcattaccttaggagtcaaactggacaaaaaggataggctattagaggaattgatggcatgcaatcacgttgcgaattttagcgttgaagatatagatgagctgaaccgtaatatcaaaaaagagattcaaatttcttcaggattgaagccgcctgtaaacacaattgacttaaccaacggcgaaccattcggaaatgctgttcctaccttcacaaagacatggagttcatccttagataatttagaaaaactatcatcggccgctgcagttggtcagagcttggactacaacagtggtttacgtcagggtcctttggcgggtggtggttcaaaagagcaaacgccaatagccgggatgaataacttgaacaattcaatcaatgctacaccaattgtcgataactcatctggatcacaacttcctaatggtttcgatagaggccaagcgaataatactccttttccaggttattttggaggtttggatttatttgattatgactttttggtttgggcaatgactttgcttaaaaattttctttccaaactcctacctattcatttcatcaat

SEQ ID NO: 180 - protein, 1062 aa, Saccharomyces cerevisiae
MVENSTQKAPHAGNDDNSSTKPYSEAFFLGFNNPTPGLEAEHSSTSPAPENSETHNRKRNRILFVCQACWKSKTKCDREKPECGRCVKHGLKCVYDVSKQPAPRIPSKDAIISRLEKDMFYWKDKAMKLLTEREVNESGKRSASPINTNNASGDSPDTKKQHKMEPIYEQSGNGDINNGTRNDIEINLYRSHPTMIMSKVMKREVKPLSENYIIIQDCFLKILVTSVFLDTSKNTMIPALTANANITRAQPSVANNLLKLKEMLIRQCQTEDEKNRVNEFTDRILQNTNSNRNLKIGMLLSMLYNSVGYQYLEDHCPQGGEYSDLLRNLINECEAILPSYEIIERYKNHFYEYVYPSLPFIELEIFEESLSQTIFPDPNNPSKVQIRMGSTHLRAKVENLSLLLVILKLSYMSIRFLDHSTADSSFYLSKEIIDKYPIPNDFILLSPRCLASENWCACANENIISCLLYIWSFFAFSPEEGDFFLEHPTDVISSLIMMLSTSIGLHRDPSDFPQLISPSTSDKRTLNHRRILWLSIVTVCSFEASLKGRHSVSPISLMALFLNIKDPDSLTVYMNRVRGDLSDINNHTLLRIHKFTFKRAQLALLLSDLDNLTMTYYGSFHLHSIEFIREKIEIFVEENFPIVPLKSVAQDKSDLDDMNVISEMNILSSENSSSFHNRIMNKLLMLRTSMAVFLHFETLITKDKSIFPFYKKYFMVSCMDALSLINYFNKFFNGEYRHAISSLTSFNVTKFIQLALSSTIFSLLGIILRIGLAIHMLSSEVQKLSGTTDPRIKELNTKVEKFSTLQRDLESALEGIYCSASEHLRFTYFPVFKMLALFDVIVQRMRKGELWHGIFTMIQMEQMHSRIIKTLSITLGVKLDKKDRLLEELMACNHVANFSVEDIDELNRNIKKEIQISSGLKPPVNTIDLTNGEPFGNAVPTFTKTWSSSLDNLEKLSSAAAVGQSLDYNSGLRQGPLAGGGSKEQTPIAGMNNLNNSINATPIVDNSSGSQLPNGFDRGQANNTPFPGYFGGLDLFDYDFLVWAMTLLKNFLSKLLPIHFIN

SEQ ID NO: 181 - DNA, 2928 bp, Saccharomyces cerevisiae
atgaaagtgaagaaatcaactagatcaaaagtttcgacagcatgtgtcaattgcagaaaaaggaaaatcaaatgcacaggtaaatatccatgtaccaactgcatttcttacgattgtacgtgtgtattcctaaaaaaacatttaccgcagaaggaggatagttcccagtctttgcctactacagctgttgctccaccctcttcccacgccaatgtagaggcttcagcagatgtacagcatctggacactgcgattaagctagataatcaatattacttcaaactgatgaacgacctgatacagactccagtctctccgagtgcgacgcatgctcctgatacttccaataatcctactaatgataataatattctctttaaagatgattccaaatatcaaaatcaactggttacgtatcaaaatattctgacaaatttgtacgctctgccgccttgtgatgacactcagctcttgattgataaaacgaagtcgcagttgaataacctgattaacagttggaatcccgaaataaactaccccaagctttccagtttctctcctcgcccacaaagatcgatagaaacgtatcttttaaccaacaagtatagaaataaaatacacatgacgaggttctccttttggacagaccaaatggttaaatcacaaagtccagattcatttctagccaccactccactagtagatgaagtatttggtcttttctctccaatacaggctttttcactaagaggtataggatatttaattaaaaaaaatatcgaaaacacgggttcatcgatgttaatagatacaaaggaaactatttatctaatattaagattgtttgatttgtgttatgaacatttgatccaaggttgcatctctatttctaatccattagagaactatcttcaaaaaataaagcaaactcctactacgacggcatctgctagtttgcctacttccccagcacctttatctaacgatttagtcatttctgttattcatcaactacctcagccatttatacaatcgattaccgggtttacgactactcaattgatagaaaatttacatgattcattttcgatgtttcgaatagttactcaaatgtatgctcaacataggaagcgctttgcggaatttttaaaccaagctttctccttgccccatcaagaaaagagtgttttattctcgtcattctgctcatcagaatatcttctatctactctttgttacgcatactacaatgttaccctatatcacatgttggacataaacactttagattacctagagattttagtgtcattgctagaaatccaaaatgaaattgatgagcgttttggatttgaaaaaatgctagaagttgcggttacatgctccactaagatgggattgtctcgttgggagtattatgttggaatagacgaaaatactgccgaacggagaagaaaaatatggtggaaaatatacagtctggaaaagcgttttttaactgatcttggtgatttatccttaataaatgaacatcaaatgaattgtctcttgccgaaggatttcagggacatgggattcattaaccataaagaatttttaacgaaaattggtacgtcctctttatcaccgtcatcgcccaagctaaaaaacttgtcattgtccaggcttattgaatatggtgagttagcgatagcccaaattgttggagattttttttcagagactctttataatgagaaattcacgtctttagaagtatccgttaaacccacaattatcagacaaaagttattggagaaagtttttgaggacattgaatcttttaggttaaaattggccaaaataaagcttcacacctcaagagtttttcaagtagctcactgcaaatatccagaatatccaaaaaacgatctaattgaagcagctaaatttgtaagttaccataaaaatacatggttctccatcttgggtgctgttaacaatcttattgctaggctatctgaagatccagaggtgataactgagcaaagcatgaaatatgcgaatgaaatgtttcaagaatggagggaaattaatcaattcttaatacaggttgatactgattttattgtttgggcatgtttggacttttatgaactgatatttttcgtgatggcttcaaaattttatgtggaagacccgcacatcactttagaggatgttatcaacactttgaaagtttttaagagaataactaacattatttctttttttaataataatttggacgagaaggattatgattgtcaaactttcagggagttttcgagaagttcgagtttggttgccatatccataagaatcatatttttaaaatactgctatgccgaacaaattgatagagccgaattcatcgaacgtttgaaagaagttgaaccgggtctaagtgaccttttgcgtgagttttttgatacccgctcttttatttacaggtacatgttgaaatccgttgaaaaatcaggctttcatttaataattagaaaaatgttagaaagcgactataaatttttgtatagagacaaattggccactggtaatattccagaccaaggaaattcaagccaaatttctcagttgtatgacagtactgctccttcatacaacaatgcttctgcctcagcagcaaactcaccgttgaagttatcgtctttgttgaactctggagaggaatcgtacactcaagacgcatcagaaaatgttccatgtaatctgcggcatcaagatcgatcgttacaacagacaaaaagacaacattctgcgcctagccaaataagcgctaatgagaataatatatacaacttgggtactttagaggagtttgtcagcagtggtgacctgactgatttatatcatactctgtggaatgacaatacttcatatcccttctta

SEQ ID NO: 182 - protein, 976 aa, Saccharomyces cerevisiae
MKVKKSTRSKVSTACVNCRKRKIKCTGKYPCTNCISYDCTCVFLKKHLPQKEDSSQSLPTTAVAPPSSHANVEASADVQHLDTAIKLDNQYYFKLMNDLIQTPVSPSATHAPDTSNNPTNDNNILFKDDSKYQNQLVTYQNILTNLYALPPCDDTQLLIDKTKSQLNNLINSWNPEINYPKLSSFSPRPQRSIETYLLTNKYRNKIHMTRFSFWTDQMVKSQSPDSFLATTPLVDEVFGLFSPIQAFSLRGIGYLIKKNIENTGSSMLIDTKETIYLILRLFDLCYEHLIQGCISISNPLENYLQKIKQTPTTTASASLPTSPAPLSNDLVISVIHQLPQPFIQSITGFTTTQLIENLHDSFSMFRIVTQMYAQHRKRFAEFLNQAFSLPHQEKSVLFSSFCSSEYLLSTLCYAYYNVTLYHMLDINTLDYLEILVSLLEIQNEIDERFGFEKMLEVAVTCSTKMGLSRWEYYVGIDENTAERRRKIWWKIYSLEKRFLTDLGDLSLINEHQMNCLLPKDFRDMGFINHKEFLTKIGTSSLSPSSPKLKNLSLSRLIEYGELAIAQIVGDFFSETLYNEKFTSLEVSVKPTIIRQKLLEKVFEDIESFRLKLAKIKLHTSRVFQVAHCKYPEYPKNDLIEAAKFVSYHKNTWFSILGAVNNLIARLSEDPEVITEQSMKYANEMFQEWREINQFLIQVDTDFIVWACLDFYELIFFVMASKFYVEDPHITLEDVINTLKVFKRITNIISFFNNNLDEKDYDCQTFREFSRSSSLVAISIRIIFLKYCYAEQIDRAEFIERLKEVEPGLSDLLREFFDTRSFIYRYMLKSVEKSGFHLIIRKMLESDYKFLYRDKLATGNIPDQGNSSQISQLYDSTAPSYNNASASAANSPLKLSSLLNSGEESYTQDASENVPCNLRHQDRSLQQTKRQHSAPSQISANENNIYNLGTLEEFVSSGDLTDLYHTLWNDNTSYPFL

SEQ ID NO: 183 - DNA, 2988 bp, Saccharomyces cerevisiae
atgtactttacagacgaatcatcaccggcaatgaatagagtaggtaaaaaaaggaatagactttcttttgtttgccaagcttgtagaaaagcaaagacgaagtgtgaccaggaaaaacctagatgtggcagatgtactaaacaaaacctcttttgtatatatgatgtcgccagacaggcggcccctaggaatccgaataaggatgccaccatagcgagactgaaaaaggagattcgttactggagaaataaaaccgtggatttgactcaagaaaagaaagacttctacactgcattgaaaaggccgactgaagaattagctgctagaaggacatgtaaaagcttgcaggaaaatagctttccaataagtctttataagactcatcccagattgattatgaccaaagtgatgaaaagagaaatcaaccctttatctgagaagtacttaatatttcaagatacctttctgaagacattaattgcctccgtgcttctaagttgttccagaaactccatgattcctgctttaaatgcagatattagtaggtcgaggacacagccatgcgtaaagaataacgttgtaaaaatgagagaggttctattgaaaaactcaaaatacgaatcacaaagaaaatccattaacgagtttacggacaggctactacagagaaagaaccctgaagaacagattgcggtaaataaagtaatttctttattatacagtaacagggaatcgtcatatttagaggatacatgccccaccgaaaacgactattctgatttgttgaaaggctacatcaatgaaatcgagaaaacgctccctcccaaggcaatcattgaacagtacctctctcatttctttgagcatattttccacctaatccctttcgccagcaaggaaatgttggaggaatcaattcacacaacagtacagtataatgaattaggagaggtacgactatcgatgggcacaacccttatacgaaataaaatggagaatctgtgtatcttactgttaattttgaggatcgcgtatatctctttgacatttatagaagataagattgaagattacagtccgtatattaccaaagagatgctagagcaatatccgattcaaagcgaagtaattttcctagcgcagcagatacttgcatcggaaaattggtgtgcttgtgcaaatgaaaataccatttcatgcttactctatatctggtgtgcatttgttttttccccaactgagggtgattttctgttagaacaaccgtcggatgttataattaaccttgtcatactaatagggacgtctatcggattacatcgtgacccatctgactttccagccttgaaccaccccgaagcttcagacaaaaggctgctaaatttacgaaggatacagtggctatcaattatctctatggcaactctggagtcaagcctgaagggtagactattggtctcacccctttcaatgattgatcttttcattgacgttcgggatcccaattgtgtagaaatctataaaaaaagggttaagaaggatctaacaggttccgaatcggatgagcaactgctcgaaatccatgagatttttttccatagggctcaattagcattattcttgtctgatttgaataatataaccatttcatacagtggttcggttccaatggatacactagaaactttacgcgttaaagccaatgaacttttaaaaaacaaatttcagctaagaagtgtggatattaacatctacgacgaagagaagacatttcaaaaactaacgttcaattcaattttgaattctataagtttatcgggccagatcttgggtaaattaatgatgttaagggcctcaatagcgctgatgttatattttgaaacacttgcaatggagagaagcgaatgcttatccttcttctataagtatttttttcaatgttgtgccgacaccatttccctaatcagattttttttcctgtatttcaatggcagttacgagaaagttctttcttctttagtttgtttcatcactacaaaagttattcaattggctgttcctaccacgatgtttacccttttggtcatcatcatgcgggtagagctggccaaaaatatgcttctggtcaaatgtaacgaatgcaatgccagaggtgacattagtgacctcccagaaataaaggagaaaataaagtcattggacactatcaaggagaacttcgagaggcttttgttggaagtatatttacttgcgtcccaaaacctgagatttaaatatttctacattttcaagatgttgaccttgtttgacgtattcattcaaaggctgaggaaaggtcaattattttctggtttgtttgtcaaagtagacaaagacttgactaccaaaaaaattgccacaatgttggagttgacacttggaattaacttggacaagtctgaccatttaattgatagactaaagggcaaaaatctcactgttaactttacccttgatcaattataccaaatcatcaaagaatttgacagaataaaaaacatcggtgttgctgacccacaaaattctctgaatccatcaaaaccaaacatgaaagataatacacccacaattgaacttttactcaactccagcgtggaaaatgagagtgtaccaccgtacagcagctcaaatgaccctacaaatgttggtaatgcctccacttatagcttagcacacaatattagtaaccaaaataatgaggaaaacatgcctccgtcaattggttcgagtgaaagtaaccgtgccgctcctaatctaaactttatgccgataaacaataactacaataacagtggttcgaacattaataacaatgacaatgttaagttaccgagtaattttaaaaactactatgaccctcccatgtcttctttggacatatccatggatgttcccgatatttttggtagccttgatttcttcgattatgacctacttttccagaacgac

SEQ ID NO: 184 - protein, 996 aa, Saccharomyces cerevisiae
MYFTDESSPAMNRVGKKRNRLSFVCQACRKAKTKCDQEKPRCGRCTKQNLFCIYDVARQAAPRNPNKDATIARLKKEIRYWRNKTVDLTQEKKDFYTALKRPTEELAARRTCKSLQENSFPISLYKTHPRLIMTKVMKREINPLSEKYLIFQDTFLKTLIASVLLSCSRNSMIPALNADISRSRTQPCVKNNVVKMREVLLKNSKYESQRKSINEFTDRLLQRKNPEEQIAVNKVISLLYSNRESSYLEDTCPTENDYSDLLKGYINEIEKTLPPKAIIEQYLSHFFEHIFHLIPFASKEMLEESIHTTVQYNELGEVRLSMGTTLIRNKMENLCILLLILRIAYISLTFIEDKIEDYSPYITKEMLEQYPIQSEVIFLAQQILASENWCACANENTISCLLYIWCAFVFSPTEGDFLLEQPSDVIINLVILIGTSIGLHRDPSDFPALNHPEASDKRLLNLRRIQWLSIISMATLESSLKGRLLVSPLSMIDLFIDVRDPNCVEIYKKRVKKDLTGSESDEQLLEIHEIFFHRAQLALFLSDLNNITISYSGSVPMDTLETLRVKANELLKNKFQLRSVDINIYDEEKTFQKLTFNSILNSISLSGQILGKLMMLRASIALMLYFETLAMERSECLSFFYKYFFQCCADTISLIRFFFLYFNGSYEKVLSSLVCFITTKVIQLAVPTTMFTLLVIIMRVELAKNMLLVKCNECNARGDISDLPEIKEKIKSLDTIKENFERLLLEVYLLASQNLRFKYFYIFKMLTLFDVFIQRLRKGQLFSGLFVKVDKDLTTKKIATMLELTLGINLDKSDHLIDRLKGKNLTVNFTLDQLYQIIKEFDRIKNIGVADPQNSLNPSKPNMKDNTPTIELLLNSSVENESVPPYSSSNDPTNVGNASTYSLAHNISNQNNEENMPPSIGSSESNRAAPNLNFMPINNNYNNSGSNINNNDNVKLPSNFKNYYDPPMSSLDISMDVPDIFGSLDFFDYDLLFQND

SEQ ID NO: 185 - DNA, 2712 bp, Saccharomyces cerevisiae
atgaagcagaaaaaatttaactccaaaaaaagtaatagaacagatttatcaaaaagaggagattctcctaatataggaatttccaaatctagaactgcatgtaaacgatgtcgattgaaaaaaattaaatgtgatcaggagtttcctagctgtaagaggtgtgcaaaattagaggtaccatgtgtttctttggacccagccaccggaaaggacgttccaagatcttacgtcttttttctggaagatagattggctgtcatgatgcgtgtgttgaaagaatatggagtagatcccacgaaaatacgaggaaatatacctgctacaagtgatgatgaaccttttgatttgaaaaagtacagttcagtttcatctttgggagaagagggaatattgccacataatggcttattggcggattatttggttcagaaagggaattctatggcatcctcagctataacgagcaagtctatggcaagcccacagactataaatgtacaacgcaaggaatttctggtaaactcaaaaaaacaagatggtagcgctttattacccgagacaggcagccctatgacttcagatgcaagagcggaagagctacgccgatgtaataaggagatcagtgcgctgggcacgatgagagaaagtagttttaactcttttttaggagattcatcgggtatttcctttgcgaaattagtcttcacggcaactaattttcgtcaagattccggagatgacgttctggatgaagatattaaacaaagggaacagaaatacaatggatatgcagaggctgaaaacaatccacactttgatccattggaactaccacctcgacatgccgctgaagttatgatatccaggttttttgtagatactaattcccagttacctttgctgcatagagaacttttcctgaaaaaatactttgaacctatttatggtccctggaatcccaatattgcattggcatctgatcagacaggcataaatagcgcgttcgaaattccaattaccagtgcttttagtgcgcatactgaaccaaaaagggagaacgttactgagaagattgacgtatgctcttccgtggatgttccatggtatgacacttgggagacatctcaaaaagtcaacatgcgtccgatagttgaactaccgacaaaatttcacataccttatttttttttaaacattatatttgctattggccatgctacgcaggtacttaagtcagatattactactgtcgcgacatataagagacgcgctactaaatatattgcatctttattttcatcttcagacaggttggaggcattggcaggcactttgctcatggtaatctattcaataatgagacctaatgtccccggtgtttggtatactatgggttctgtactaagactaacggttgacctaggactacattcggaaaaaattaataaaaattatgacgcctttaccagagaaatacgcaggcgtctattttggtgcgtttactccttagatcggcaaatttgctcgtattttggtcgaccttttggtatacctgaagaaagcatcaccaccaggtatcctagccttttggacgattccttcatcacattaactaaccgagaaattgacgactactcagacttaccaagcccaaatccgtcttcaaaagttatcgcattggccatgtataaaatcagaagaatccaagctagtatagtgagaatactctacgcgcccggtgcagaattgccgaggaggtttatggatctcgagagctggcggattgaaacctacaatgagcttgagcgttggttccaagtggacgttcccaaaaactttgagatgatgaattgcaaatttaacagcatctggtttgatctgaactatcattactcgaagagcattctttatggactttctccaaaattccctactttgaatgataccgcttttaaaattgtcctggacagtacgaagggcaccatagacgtattttacaatctttgtgtcaataaaaaaattggttacacgtgggtagcagttcataacatgttcatgacaggtatgacttacctttacgtaaatttttactcaaaaaacaacataaatgattgtcaagaaaaagtgtcagagtacactgaaaaagtgttgatagtactgaagaatctgataggtttttgcgaatctgcgaaaacctgttacacgagttacaaaattttatcatcagttgtaataaagttaaaatttatgcaaataaatgatgccaaagggatattttcggattcaaatcccctaacctctcaggcaaaccgcatgtcaagttatgataaaaaaacgaacgtacttggttttgacgacggtacttttgataacaaggtttttaatagaaccaattttgaagaaaaagcaccttttgatatacctctagatgaattttttaccgaactggaaaaacacagcaatgtttcccagtttaatactttagatgtaagcgaaggtaatcaagtgataaatgaaagtgcttctacaaatacgtcttctgcattgaattgccagtcgtataccaataatcaagatatcatggatatccttttccaggttacttcgggatctgtatgggatgagttttttgtcaggtctggtaacggaaacgaaggcgagtcttcttacgatatcagtaaaggaaagaactctgaatccggtggaatattt

SEQ ID NO: 186 - protein, 904 aa, Saccharomyces cerevisiae
MKQKKFNSKKSNRTDLSKRGDSPNIGISKSRTACKRCRLKKIKCDQEFPSCKRCAKLEVPCVSLDPATGKDVPRSYVFFLEDRLAVMMRVLKEYGVDPTKIRGNIPATSDDEPFDLKKYSSVSSLGEEGILPHNGLLADYLVQKGNSMASSAITSKSMASPQTINVQRKEFLVNSKKQDGSALLPETGSPMTSDARAEELRRCNKEISALGTMRESSFNSFLGDSSGISFAKLVFTATNFRQDSGDDVLDEDIKQREQKYNGYAEAENNPHFDPLELPPRHAAEVMISRFFVDTNSQLPLLHRELFLKKYFEPIYGPWNPNIALASDQTGINSAFEIPITSAFSAHTEPKRENVTEKIDVCSSVDVPWYDTWETSQKVNMRPIVELPTKFHIPYFFLNIIFAIGHATQVLKSDITTVATYKRRATKYIASLFSSSDRLEALAGTLLMVIYSIMRPNVPGVWYTMGSVLRLTVDLGLHSEKINKNYDAFTREIRRRLFWCVYSLDRQICSYFGRPFGIPEESITTRYPSLLDDSFITLTNREIDDYSDLPSPNPSSKVIALAMYKIRRIQASIVRILYAPGAELPRRFMDLESWRIETYNELERWFQVDVPKNFEMMNCKFNSIWFDLNYHYSKSILYGLSPKFPTLNDTAFKIVLDSTKGTIDVFYNLCVNKKIGYTWVAVHNMFMTGMTYLYVNFYSKNNINDCQEKVSEYTEKVLIVLKNLIGFCESAKTCYTSYKILSSVVIKLKFMQINDAKGIFSDSNPLTSQANRMSSYDKKTNVLGFDDGTFDNKVFNRTNFEEKAPFDIPLDEFFTELEKHSNVSQFNTLDVSEGNQVINESASTNTSSALNCQSYTNNQDIMDILFQVTSGSVWDEFFVRSGNGNEGESSYDISKGKNSESGGIF

SEQ ID NO: 187 - DNA, 1695 bp, Shiitake mushroom
atggaagtccatgctgaacaattacaaaagccccccgttgtccgtggtgcccgagcatgtacgacgtgccgtgcagcaaagatgaaatgcgtcggagctgaggatggacaaagacagtgccagcgttgcaagcgtgcaaacgtccaatgcatttttgagaaacatcgtcgaggccgcaaaccaggctccaagctttcggaagcttccaaaatgttacgacgtttggagaagggtctcaatagtgccaaatccaaagctttctctatagacgcaagacattcatcctcgtatcgagactcgcatccgtctcttggtgagccagatgaccgttataccaacggtgtccgtagtcatccctacagccctccaaatgggcaattcgtttcaaatctaccacctctcaatctcccttcctatcctgatgctgccagcgaatacactgcatctagtacaagctctcgtaccttggacgcgaatgatgatgaaggcgacagtgcgtccgatcgcgcagaggataacattttcccggccaactttattcagcgggagcgtagacgaaattccttctttagaacaatactcaatcctgaagacgctcctgcctcaggaccatcttctgtccgttgctctgagacgtacagccctcctcaatctcctgccgctcctgccggtcttaacgaccccgtatcagccggtattgtggatgaagagcatgccaaagttctatttgatctgatcttccttcgtcttaatcccttcatcaatctttttgatccctctctgcatacagtttcatatgttaggaacaaatcgccgtttttgttcactgtcttgataatggccggctgtaaattcttcaggccggaactcttcaagcagtgccagaaacttgcggacgaatatgctgtccaagcttttgcgtgccttacttactggaaaggccacgatgacaatcgtacgagtacctggacctttgtaggttatgcatgccgaatgcgtgtggagatcggtctcaatcgctatgtccccaatgttccgtccaatgaaaccgaactacaacgattggagcgtcgtaatcgagaaagaacttatcttgttcttttcatccatgatcgcagcctcagcacccagacgggtcgccactggatgcttcccgaggatgactttattcgacattccgatagatggcacgaaagttccggaggttctgttcgaccggaagacgttattgtggctgctttcgtgcaattgcggcacattgctgctgaaacgacagagatattccaaagaggtgttgacatgagttctgaagttgtactacgtagctgcaacagtcagctaacccaatggaatgaaacctggcatcgagagatgcaacaagcgggaggaggtgccttccatttttcgttccttagtctgtttcggttatacgttcgattgttcactaacagccttgcacttcgagaatcgtccaatcgagctactccgaacattcaagctctttcagcatgttatacgagtgccgttgattccctgaaagtcgtctcggaatttgctagaatgaatgtattgcgctatggacaggagactatcacaatgatgtccgcatatgccgcactatatttattaagcctactccgcaatacacttcgttactgcagctgcacgatggcgcaactcaaaatgcgtatactg

SEQ ID NO: 188 - protein, 565 aa, Shiitake mushroom
MEVHAEQLQKPPVVRGARACTTCRAAKMKCVGAEDGQRQCQRCKRANVQCIFEKHRRGRKPGSKLSEASKMLRRLEKGLNSAKSKAFSIDARHSSSYRDSHPSLGEPDDRYTNGVRSHPYSPPNGQFVSNLPPLNLPSYPDAASEYTASSTSSRTLDANDDEGDSASDRAEDNIFPANFIQRERRRNSFFRTILNPEDAPASGPSSVRCSETYSPPQSPAAPAGLNDPVSAGIVDEEHAKVLFDLIFLRLNPFINLFDPSLHTVSYVRNKSPFLFTVLIMAGCKFFRPELFKQCQKLADEYAVQAFACLTYWKGHDDNRTSTWTFVGYACRMRVEIGLNRYVPNVPSNETELQRLERRNRERTYLVLFIHDRSLSTQTGRHWMLPEDDFIRHSDRWHESSGGSVRPEDVIVAAFVQLRHIAAETTEIFQRGVDMSSEVVLRSCNSQLTQWNETWHREMQQAGGGAFHFSFLSLFRLYVRLFTNSLALRESSNRATPNIQALSACYTSAVDSLKVVSEFARMNVLRYGQETITMMSAYAALYLLSLLRNTLRYCSCTMAQLKMRIL

SEQ ID NO: 189 - DNA, 2454 bp, Aspergillus nidulans
atggacgaggccccatcaacacccgccgtgggcaaccagaaacgaccccgcgtttcggaggagaaccgcaaaagagcggtgcgcgcctgcgacggctgtcgtcgcgtcaaggagaaatgcgaagggggcgtcccctgccgccggtgcactcgatatcgccgccaatgcgtctttacacacccagaccaagcagacaggctctcgcgctcatcgtccatctcactcctagaacgaaccgccgcgcgcagccgccatgacatgctcgagtcggagaggatccggtgcatggaacggatcttacagcactacgtaccgaacatttctttcgatatacagtcgctccggaaaacagcggaggagctgaagagtaaacaccgtggttcagactcggatggaggaccttcggtcgtctttgacaacgaggatatggaggatttggcgatcgaggacgaggactttacaataaaggctttgccggataatacgacgcaatattccggcgaattctcctatctgaatttctcaatgaagattaagaagaagattgatgagtggatgaaagccgagtccccagaggcatctaccgaagcagagccttttgaagagcgatggcgcgcaacgcaattacagtctggcgccgtggtagccgcttcggttacaagtctaccgccacggttcgtggccgacttcttagtgcagatgtttttcaagtacgcgcaaacaaacaacttctacgtcgaagaggactggctcaaagataagctcaacacttgttacgtgaatccagggagtctcggatgcaacgatgccggcgcggtgtgctctatcctgatggtcctagcgattggaacacagttcgcacacatggaatcggcaaccccggtaaaccacttaactagcgaagctgaccatttctcggaagacgaggttgggttgacgttctaccaatttgcatccaaattgcttcctgacattattgcctccgcctctattcgaagcgttcaggcctgcctgttgattgggacatatctattgccgctcgatacgtcaggtctttgctacacttattttggccttgccttgaaaatggcgatccagaacggtatgcatcggaagtacagcggcgaggggctaccgccccatgtgatcgagattcggaatagggtattttggacagcatataccatcgagaaacgagtcagcattctccatggcagaccggtatctctgtcagatacggatgtagacgctgcaatgcctgtcgatttccctggattgatgccgcacggccaagtttctaaccataccaatatggtaacattgataaaattgaccctcaaacttggggaggtctcaaatgagatatgcgccctccggaaatgccgcaaaaaccaacaacaagactgccttgaacgactcctcaccctccgcaaacatctggtcgactggtggaacaccctccctgaagaaactgactgccgagacctaaacccaaacggcccgcttttcagagcaaacgttcacctaaagctggactactgtctaacacgaatcttccttggtcgtccctttctcttcagcagtatgaagggcttttcctctgccaccttccagatctcgccagtaaaggcgcccatgtcctccggtgtctccaagaaccgctcaacccttgtcacggactgcgtcgaggccgctcttgaaatcattgatctttgccggttacttcgagatgaaacgggtcttgcccgtgcctctttcacagagtttagctcatgccgcgccgcactattggtcattcttgcgcagagcttgacaaagcgtacagaacgactccgggaagcgctgcagaagggcatggggcttattaagattatgtccatgggtgtcgggtcggccaggtctgcggttagtgttattgaggcacttgagagggctatctcccgtcttgaagagtatagtcgttcgcagggcgccggacagtcgggaagtcatgagtctgcctacgaccgctttaagaattgggaaatgctttggaagactggtcctgtgtctccggatgcgcacactcttacgaacgcgaacacacataccaacattttccaaagtcaagggcaggggcaagacggttaccagtctggcggtagcggagttcaaccacacttggccagtcttactccaacctcaagccttatgaactctcagagccagttacacaacgagaacgcagctgtcccgcatcacgatatcacctcgccgtcggatttcttgacaccccatgcgttctcgcaaatgccgcacattgggctcgatcatttcgtctccaacctgcctcaggaactaggtgaattcacggctattccgtgctttgagacagagggacaaacgggacccagctcgggagcgggaccgggtctcccaggagagttggatatgaaagaggggtggatgacgttt

SEQ ID NO: 190 - protein, 818 aa, Aspergillus nidulans
MDEAPSTPAVGNQKRPRVSEENRKRAVRACDGCRRVKEKCEGGVPCRRCTRYRRQCVFTHPDQADRLSRSSSISLLERTAARSRHDMLESERIRCMERILQHYVPNISFDIQSLRKTAEELKSKHRGSDSDGGPSVVFDNEDMEDLAIEDEDFTIKALPDNTTQYSGEFSYLNFSMKIKKKIDEWMKAESPEASTEAEPFEERWRATQLQSGAVVAASVTSLPPRFVADFLVQMFFKYAQTNNFYVEEDWLKDKLNTCYVNPGSLGCNDAGAVCSILMVLAIGTQFAHMESATPVNHLTSEADHFSEDEVGLTFYQFASKLLPDIIASASIRSVQACLLIGTYLLPLDTSGLCYTYFGLALKMAIQNGMHRKYSGEGLPPHVIEIRNRVFWTAYTIEKRVSILHGRPVSLSDTDVDAAMPVDFPGLMPHGQVSNHTNMVTLIKLTLKLGEVSNEICALRKCRKNQQQDCLERLLTLRKHLVDWWNTLPEETDCRDLNPNGPLFRANVHLKLDYCLTRIFLGRPFLFSSMKGFSSATFQISPVKAPMSSGVSKNRSTLVTDCVEAALEIIDLCRLLRDETGLARASFTEFSSCRAALLVILAQSLTKRTERLREALQKGMGLIKIMSMGVGSARSAVSVIEALERAISRLEEYSRSQGAGQSGSHESAYDRFKNWEMLWKTGPVSPDAHTLTNANTHTNIFQSQGQGQDGYQSGGSGVQPHLASLTPTSSLMNSQSQLHNENAAVPHHDITSPSDFLTPHAFSQMPHIGLDHFVSNLPQELGEFTAIPCFETEGQTGPSSGAGPGLPGELDMKEGWMTF

SEQ ID NO: 191 - DNA, 2937 bp, Saccharomyces cerevisiae
atggtgaccgaccaaggcagtaggcattcgatacaatctaagcaaccagcctacgttaataaacaaccgcaaaaaaggcagcagagatcttctgtcgcatgcctttcttgtaggaaacgtcatataaaatgtcctggtggtaacccttgccaaaaatgtgttacgagcaatgccatatgtgagtacttggagccgtcaaaaaaaattgttgtgtcgacaaagtatctgcaacaactgcaaaaagacttgaatgataaaactgaagagaataaccgcctgaaagctttgctcttggagagaccagtgagtgtacgtggtaaggataacagcgatgatgacgagaggcatataaacaatgcaccctcaagtgacacattggaagtatccagcgctccggcggctcctatatttgacctcatgtccaatagtaacactgcgtccgataacgataacgacgatgacaacagcaacagaatcacaaataataggagctatgatcatagtttggaaaaatactacaaaaaggccatcagcatctttaaacaaccagctaatgctaatggcgaaaatggcaacggtgccaatggtcatgaggatgatgatgaagatgatgaagaaatatcaacaaattttgctcaaagaagtggtaggctcatagaatctcacaatggattccattattttgttggatcttcttcaatgacattatttgggttagaaattcaatctttggttacaaagtatatttcggtcaagaattttcgacctttgccaataaacaccaaaaacaagattttaaattcaaacctgaacccggctataagttcttttatcaattcaaacaactatcttttctcgtcctataattttttgaaccctatatcgactattgtcaacttaaactcaatcaacgataatttatctccattgatgtttaagataattttgaaaagcgatacggatggtagtagtggccaggaagaggtaatacagtttcagttgccttcgtataattacacaaaactattaattgactgctttataaattataacgatggttgtttttactttttcaacgaaggcctggttaaatgtggcattaacaaattgtacttggaaaataaatggctatactatgataataccaaaaaagctttggacaatgagaatgatccaattttacaagctgtttggttttgcaaaattttgttaattttagcagtaggtgaaatgtatctgggttccatcaataatgaaatgttgaagaattattctaatcagccaaaattgcccggttcaaaattttttcaaatgggttctaaaatttttaattgtttgttctcaagtgaaagattagaaaatgtgactaagaaaggcggtattgaagtcctgttgttatacgcgttcttcttacaggtggctgattacactttagcctcttatttttacttcggtcaagccctaaggacgtgcttaattctaggcttacatgttgattctcaaagcgacactctatccaggtatgaaatcgagcatcataggagactttggtggacagtttacatgtttgaacgaatgcttagctcaaaagctgggttaccattaagtttcactgattatacaatctctacagcactgccagcggatattgatgatgaaactatcgaagagaaaaatagtcactatgttttcagaaaggcagaattgatttctaactgcgttactattgtgaaaatcaatgcacaaattttgagcaaattatatcaaaggcaacctgagacaaacatcataattactttgaaagttgtcatcaagcagttgttggaatggaggaacaatttgtccgattccttacaggtggattttacgcaaaaggatgaagatttcaaaatatcgagattgtcaaccaatatgtttacggaatattttcaaggaataaacttggccgtgagacctttattatttcattttgcatccattcaattgaaaaggttcaaaacgagcaatactttcgtcaacttacaaaactattctgccacaatatcttccttattaacatgttctttgcatgcttctgtgaatactattaggtctctgtggagtttattacagaatagtatgcttgctatgtttagttatatggacagagagtatctttttacttcttcttgtactttattactattcaacactgcttttggtattcatgaacaaacactatatcatttggatcattctctggaaattttcacacaaatgagaaacttaggcaacattccagcaggcttaagaagagcacaattattaacattaatggcaaatttggatttccacggcataatgaatgacttgattactaaatataacgatattttgaaatttgattctatgaattgtgaaaacgataacatagtagaagatagcaatgaacccaaaagagaaaccgaaaagtgtaaacctcacaaagatggcgatcgcattgacccttcaattatagactgtgataaatcaaacaccaatacaaatatgatcaagaacgaatctatatcgaacattgttagcatacttccggaaggcgcgaaaccaacgctgactgattatagtaatggtaataatgatgttaatgatattaacgtcaataactcggaaccttctactttttttgatatcataactgcgagcttggaaaattcataccaaaccacgctaactgaaaagggctctcaggtgatggaaaaaaacatggatcagttggattccgttcataatctaaatgatgacgatttacaacaattgttggaggatttaggcaatattgatcattccgatgaaaaactttggaaggaaatcactgatcaagcaatgtggctgggaaatactatggatccaactgcagctgctggtagtgaaattgactttactgattatttaggacca

SEQ ID NO: 192 - protein, 979 aa, Saccharomyces cerevisiae
MVTDQGSRHSIQSKQPAYVNKQPQKRQQRSSVACLSCRKRHIKCPGGNPCQKCVTSNAICEYLEPSKKIVVSTKYLQQLQKDLNDKTEENNRLKALLLERPVSVRGKDNSDDDERHINNAPSSDTLEVSSAPAAPIFDLMSNSNTASDNDNDDDNSNRITNNRSYDHSLEKYYKKAISIFKQPANANGENGNGANGHEDDDEDDEEISTNFAQRSGRLIESHNGFHYFVGSSSMTLFGLEIQSLVTKYISVKNFRPLPINTKNKILNSNLNPAISSFINSNNYLFSSYNFLNPISTIVNLNSINDNLSPLMFKIILKSDTDGSSGQEEVIQFQLPSYNYTKLLIDCFINYNDGCFYFFNEGLVKCGINKLYLENKWLYYDNTKKALDNENDPILQAVWFCKILLILAVGEMYLGSINNEMLKNYSNQPKLPGSKFFQMGSKIFNCLFSSERLENVTKKGGIEVLLLYAFFLQVADYTLASYFYFGQALRTCLILGLHVDSQSDTLSRYEIEHHRRLWWTVYMFERMLSSKAGLPLSFTDYTISTALPADIDDETIEEKNSHYVFRKAELISNCVTIVKINAQILSKLYQRQPETNIIITLKVVIKQLLEWRNNLSDSLQVDFTQKDEDFKISRLSTNMFTEYFQGINLAVRPLLFHFASIQLKRFKTSNTFVNLQNYSATISSLLTCSLHASVNTIRSLWSLLQNSMLAMFSYMDREYLFTSSCTLLLFNTAFGIHEQTLYHLDHSLEIFTQMRNLGNIPAGLRRAQLLTLMANLDFHGIMNDLITKYNDILKFDSMNCENDNIVEDSNEPKRETEKCKPHKDGDRIDPSIIDCDKSNTNTNMIKNESISNIVSILPEGAKPTLTDYSNGNNDVNDINVNNSEPSTFFDIITASLENSYQTTLTEKGSQVMEKNMDQLDSVHNLNDDDLQQLLEDLGNIDHSDEKLWKEITDQAMWLGNTMDPTAAAGSEIDFTDYLGP

SEQ ID NO: 193 - DNA, 2448 bp, Neurospora crassa
atgccgcctaaacgcaagacactcaatgccgctgccgaagccaatgcccacgctgatggccatgctgatggcaatgctgatggtcatgtcgctaacactgcagcaagcagcaacaacgcccgttttgcggacttgaccaacattgacacacccggcctcggccctaccacgacgacgttacttgtcgagcccgctcgttcgaaacgccagagagtctcgagggcctgtgatcagtgtcgagctgcacgtgaaaagtgtgatggaatccagccggcttgcttcccctgtgtgtcgcagggccggtcgtgtacctaccaggccagtcccaagaagcgaggagtccagacgggctacatccgcactctcgaactggctctggcttggatgttcgagaacgttgcccgcagcgaggacgccctccacaatcttttggtccgtgatgctggccagggcagcgctctcctggtcggcaaagactcgcctgctgcagaacgcctgcatgcaagatgggcgacgagtcgagtcaacaaaagcatcacccgtcttctctcaggtcaggccgcacaagatccatctgaagacggccaatccccgtccgaagacataaatgtccaagatgccggggcaaagacatccgacttccctcatgcgcctcacttgactttctcggcgcctaagtctagtacagctgagacacgcactctaccaggcccggtccgaccacctatttcggcaaacaccctggaaaacaaccttcagccagatggtaccgggatagggaagctaccacccaatcattggcgcctgctggatatctacttttcctacacgcattcttggctccctatcctcgagaagaaagacatgtaccaagcattgtaccagtactctgaacaaggctcgttgcttccctctgcgaatgtcgagtctggcgttcatgccgagctctggagcgcgctcgccctggcgtccttccaggctgctgctactgctgcatcgagtgctacgggtccagcttcagctgctcatggccatgacaatgccatcaatccttcacctgcagacatatctgacacagcccgaaagctcatacctttggaaagcgggccgttccaggttcagcactgcagagcgttgctgcttctttgtctcgtaagccttgggcgggatgattgggagtctgcttggttgctggttggctttgcggtccgcgtcctacttgttgttcgcacccagttgcctcctgatgatgaccggccacgaccaagaatgcgtgcgctgctcgtcgcgtgcttcatcgtggataccattgtgtctatgagacacaacgtgccggcccatctcaagccagacgacattgcggatctgccgttacctgaagacggtcaagatcaatgggagccgtggacaccatgtgagggcttaggcggtgaacacaccatgctgcaaatgttgaggaacccggcataccctttaagcacattcaaccacctatatggcgtgaccaagctggttgctttggagcttctgccaagaatacgaacatcttcacagaacgctcccttggagttcaggtcgcggttgcagcaggtaatcggccacaattctcccttcagcgtctttgtcctttcccaggatacagcatcggcttttgtgcctactgcataccttacccgtaccgtttatttatgggcagctgccttttctgagcctctcaacgaacactactcgcatcttctgatcgaaactcttgatcagtatcagaagcggtttggtacatatgcaatcccacctctgatcccttctcttctagactcccttcttgctttaaagaaacaatcacattcttcagagcggcatcgaaggcacttggaagagcttttccccgcctactcctccatttggcctcggggaggccgacacagcaatactggcctccaacccatacgacaacttgagcttccgccgactgcgactgccactgcaagtatcatgccccatgtcatggaacagcccctgtcaacgtcaataaatccggtcaatgatcggtttaatggaataccgaatcctaccccctacaatagcgatgcggccctagacgcaattactcaaaccaatgactacggatcagtcaatacccatggcattctcagtacatatccaccacctgccacccacttgaacgaggcctcggtggcccttgcgcctggaggtgctcctcccagaccacccccgccatacgttgatagtacaacgaaccatcctccttaccatagtaacctcgtccccatggccaatttcggatattcgactgtagactatgatgcgatggtggatgatctggcatcgatcgagtacacggatgcggttgacgttgatccgcagttcatgacgaacctcgggtttgtcccagggtgtaattttagcgatatcaacacgtatgagcaa

SEQ ID NO: 194 - protein, 816 aa, Neurospora crassa
MPPKRKTLNAAAEANAHADGHADGNADGHVANTAASSNNARFADLTNIDTPGLGPTTTTLLVEPARSKRQRVSRACDQCRAAREKCDGIQPACFPCVSQGRSCTYQASPKKRGVQTGYIRTLELALAWMFENVARSEDALHNLLVRDAGQGSALLVGKDSPAAERLHARWATSRVNKSITRLLSGQAAQDPSEDGQSPSEDINVQDAGAKTSDFPHAPHLTFSAPKSSTAETRTLPGPVRPPISANTLENNLQPDGTGIGKLPPNHWRLLDIYFSYTHSWLPILEKKDMYQALYQYSEQGSLLPSANVESGVHAELWSALALASFQAAATAASSATGPASAAHGHDNAINPSPADISDTARKLIPLESGPFQVQHCRALLLLCLVSLGRDDWESAWLLVGFAVRVLLVVRTQLPPDDDRPRPRMRALLVACFIVDTIVSMRHNVPAHLKPDDIADLPLPEDGQDQWEPWTPCEGLGGEHTMLQMLRNPAYPLSTFNHLYGVTKLVALELLPRIRTSSQNAPLEFRSRLQQVIGHNSPFSVFVLSQDTASAFVPTAYLTRTVYLWAAAFSEPLNEHYSHLLIETLDQYQKRFGTYAIPPLIPSLLDSLLALKKQSHSSERHRRHLEELFPAYSSIWPRGGRHSNTGLQPIRQLELPPTATATASIMPHVMEQPLSTSINPVNDRFNGIPNPTPYNSDAALDAITQTNDYGSVNTHGILSTYPPPATHLNEASVALAPGGAPPRPPPPYVDSTTNHPPYHSNLVPMANFGYSTVDYDAMVDDLASIEYTDAVDVDPQFMTNLGFVPGCNFSDINTYEQ

SEQ ID NO: 195 - DNA, 2475 bp, Aspergillus nidulans
atgagtagcgatacccgccaaacctccggtggtaacgccaggtcgaaacggcgattaaccgatgcggtcgacgaggatggcagaccgaccgccacggccgaagatcctacgtctaatccaaaacgccaacgagtctctcgagcctgcgatagctgcagatcgaagaaggataaatgcgacggagctcaaccaatatgctcgacgtgcgcctctctttcgcgaccatgtacctacagagccaatccgaagaagcgcggcctcccgactggatacattcgcacgttggagttgctatgggggcttgtgttcaataagatacagggcagtgaggaggtcgtccggacattattgagggcggcaaatattcccagccacctggcaaccatggggaaagagtcggaggggtctgatacactgctctcgtcttggaaaaacagcattgtcttgaaagagattgaacgtctcttgacgtttctcgagcaaccggaaggggaccaagaaagaagcgcgagaggagaaatcgattccccagcggatgctgaagaaagcagtgtgctttctccggagacgcttgagtggcagcttccagattctatcgcggttgcgagtcaaagcccgttagcgtctgggccatccccagtgaggctgcctaggccatccacaacccgtctcgtcagggactctggcacgcaaacgattcccctaggagaaatcgaagaccttaccactaacggatcatcccacgatcggcctgtgatcgcttccaattctgcccgagaagaacaccgcttgcctcctaacccttggcctttacttgatatatacttttcctacacgcaatgttggttcccaatattagaaaaacacgatattcttcgaacagctttccgccaaggtgacgatgaccaatacaactctccatccgccgcaggggacaacgcggccttgtgggctgttctagcacttgcctcaatccaacaaacctcaatatccactacgcgccagttatcagacttaccagaggaccgacctgatcctgatcaactatatgccaaagcacggagtcttatcccaacagagagtgggacctaccagctcggccatattcaagcgctcttaatcctgtcattgataaagcttggccagcaggactgcgcagcagcgtggatgcttgtaggacaggctgttaggtctgcccagagtctagggttaaatgatccttccgatgctacgggagtagagaagaccgctggacggtccaaacatgtttttctagggtgctttgtgctggagactctagttgctgctaaattaggcctgttgccttccgtgcgcaagactgacttgacaaaggttgggttaataaatgaagatggtttggaagaatggcacccttgggaagaccagactggacttcgcccgatagaatcatcccgctctttccaacgcgggcccctccatgctctcagcactttcaaccgtctgctctcgctaatgtgcattctgaatgagttatgttgcgtgaggcaaacaccagcgaattccatgtcatatctagggactcttgagcgacaactgcagctttgggtctcggcacttcctacaagttatcggatagacctgcagacagtctcgaccaagccggcatcaccccacatattcggcctagagatgatgtacgaggccgttgcaaccgctataagcttacagctggcagtccagaaaaacgaaagaaacggattacgacgtgcttcggaaggctccaagcggttggtctcactacttcaagcctacatggagacctatagcctttctgctacctgcccgactttcggtatagctctgactttaggccttccacttccctgcatgaagaaaactgccccatggccctttgaggcttctcatggcatcaaccacaaactccaatcgttttctgcccatctcgcaacggtttggatccataatactggctcgcagagaagaccgagacacgctacacagcaaggtacccatccaaggagtccgatggccataagcctgcccggaaacaatatgcgtttgacgaacttaatcgaagaatctcgaactgggaatctttcaaccactgactcatatctttcgccaacttggatgcggacttcgaacgatgaaaacgctgtattatctctaccgacgccagcatcgtctcttaatatcgcgtctggagttgaaacgaaccctacttcgcagcaaatcacccatcaacatcgctcttcggtcgttggaaagcctaactcagcactgataatgtccgacctgacgacgccttttcctgcgtccggtcatcactatcaacaaacgtatgatgatgccagtttgcacttcaattctttagccgacatccagagcactagctcagcacaacgaccaaggattgctcctgacctcgatgccttgtttgacgagttggcctcgcttgatgggacagatagg

SEQ ID NO: 196 - protein, 825 aa, Aspergillus nidulans
MSSDTRQTSGGNARSKRRLTDAVDEDGRPTATAEDPTSNPKRQRVSRACDSCRSKKDKCDGAQPICSTCASLSRPCTYRANPKKRGLPTGYIRTLELLWGLVFNKIQGSEEVVRTLLRAANIPSHLATMGKESEGSDTLLSSWKNSIVLKEIERLLTFLEQPEGDQERSARGEIDSPADAEESSVLSPETLEWQLPDSIAVASQSPLASGPSPVRLPRPSTTRLVRDSGTQTIPLGEIEDLTTNGSSHDRPVIASNSAREEHRLPPNPWPLLDIYFSYTQCWFPILEKHDILRTAFRQGDDDQYNSPSAAGDNAALWAVLALASIQQTSISTTRQLSDLPEDRPDPDQLYAKARSLIPTESGTYQLGHIQALLILSLIKLGQQDCAAAWMLVGQAVRSAQSLGLNDPSDATGVEKTAGRSKHVFLGCFVLETLVAAKLGLLPSVRKTDLTKVGLINEDGLEEWHPWEDQTGLRPIESSRSFQRGPLHALSTFNRLLSLMCILNELCCVRQTPANSMSYLGTLERQLQLWVSALPTSYRIDLQTVSTKPASPHIFGLEMMYEAVATAISLQLAVQKNERNGLRRASEGSKRLVSLLQAYMETYSLSATCPTFGIALTLGLPLPCMKKTAPWPFEASHGINHKLQSFSAHLATVWIHNTGSQRRPRHATQQGTHPRSPMAISLPGNNMRLTNLIEESRTGNLSTTDSYLSPTWMRTSNDENAVLSLPTPASSLNIASGVETNPTSQQITHQHRSSVVGKPNSALIMSDLTTPFPASGHHYQQTYDDASLHFNSLADIQSTSSAQRPRIAPDLDALFDELASLDGTDR

SEQ ID NO: 197 - DNA, 3510 bp, Saccharomyces cerevisiae
atgaacgagctgaacactgtttcgactaactccagtgactccaccaagaacggtggtacatccaatagtcccgacgatatggactccgcagcagcagcaagtcacgcaataaagaaaagaacaaaggcctcccgggcctgcgatcagtgtcgtaaaaagaagattaaatgtgactacaaagatgaaaagggggtctgctcaaactgccaaaggaatggagaccgttgtagttttgatagggttcctttgaaaaggggaccctcgaaaggctatacgaggagcaccagccatccaaggactaacgaaatacaagaccacaataactcaaggtcgtataatacgtttgataatagtaacaataccctgaataataatacgggcaatagcggcgacaacggtataaacagtaacacagttccaagtaccccttcgagatctaattcagttttattgcccccactgacacagtacattccccaggctggtggcattcctcctagtttccaaaatccagcgatacaatcaactatgcccgcgggtaatattggccaacagcagttttggaaagtgccctaccatgagtttcaacaccaaagaaaaggatctatcgattctttgcaaagtgatatatcggtaagaacattaaatcccaacgagcagttgtcttataacaccgttcaacagtctcccataacgaataaacatactaatgattctggaaatgcaaacggaagtgtcaccggctcaggcagtgcctctggtagtggtggttattggtcctttataagaacttctggtttactagctcctactgatgatcataatggggaacagacaagaagatcaagttccataccttctttgctacgaaatacttcaaattctcttttactaggtggccagcctcagcttcccccacctcagcaacaatcgcagccacaagcacaccaacaaaagttgcaacaaggacagaacctatactcgtattctcaattttcccagcagcaaccgtacaacccatcgatatcatcttttggccagttcgctgctaatggttttcattctagacaaggatcagtcgccagcgaggctatgtctcccagtgcacctgccatgtttactagcacatctacaaaccccgtaaatgttgcacagcaaacacaaagacctcaaggacagcaggtaccgcaattttcatctgagttggatggaaataaaaggcgacaatcagcccccgtatcagtaacattatccacggacaggctgaatggtaatgagaataataatggtgaaattaacaacaataatggcagcaataatagcggttcttctaaggatacatctcaacattcccaagaatctgtaactacaccagcggctttggaagcatccagccctggatcaacgccacagagaagtacaaaaaaacgcagaaaaagttacgtatctaagaagacaaaaccaaagagagattcatctatatctataacatcgaaagattctgctcacccaatgaccacttcatcaactatcgcgtatggacagatatccgatgtagatctaatagacacctactatgagttcatacatgtaggatttccgatcatacctttaaacaaaacgaccttgaccagtgacttattgttagttaacacacagccaatttccaatatacacgaagtcaattcatatgttattttgtggtttagaaattcattggaattgttagttcgtgttgctctgaaacaaaagccaggtggcaagtttttcgataatattgttggcgtggctttgtcgccaagtaatgacaacaacaaagctgggttcactacagccacggcaagggatgatgctgaaaaaacaagacgtgattcacataatgaagtacaggatactttggaagtgcaaagcgtttttattgccgccctcaatgaatgtttccaaaaaatcgtggatattcatcccaaattcagagaaaacaacgaccaaatttcgccgaagatcaaagtcatttatttatctacttttattcttttaaattacattttggcatttgttggatacgataactcatttgtacttggaatgtcggtgacaatttttaacgaatttaaattatacaaacttctattatttccggagccggatataaatgatgtgaagcctccagttgatgaagaggtcagcactggtaatgggaatacaaaaacgtccgaatttgaaattggatctgaaagtgctgggcatatgaatccatccaattcaccaaattccatggacgaaaacattagtcactattcagtgttgtttaaaagattatacgttttgctttcagtgtttgattctttacaaagctgtgcattcggtggtcccaagctattaaacatttccatccaaggttctacagaaagatttttttctaatgatttgggctcaaaatggtgcctggaacaaagccaattgagactgaaaagcgtcttgcaaagcttgaaattgggtgaattgatgagtgagcttaccaggaatagaatatcaatgaacggcaataggaagcctgggttcgatattacgaactcgtcttcactcttatcggaatatgtggaaactcaacctctatccgtagcacagttattttgcaagctattaattggcaaacacaatttcatcaattgcttattatcattatacgattcagaagcaggagtctattcagatttgacattggatttgagttcgaaaatagcagactctctgtgctcattgatatcaataattttgcaagtattgacgttgatattaagactgaatcctacgaacagtattgattttaattatagaccaccgaacccacccgctaataatccgacagtgcaagagggcccatctgctatgggctcgtctccagtcgctgggaaccttagcgctgcacctccatcggaggggaatccagatttttacaagaaattactaggcctgaaacaagacactggcactatcctttcagacctttgccgggggataatttccccctttgctattgctatcctgcacgaggtctacaacatcactgaactggtcaagcagatgcctacatcactcattagcattatgatgacggcaactacaacgcagaatactcaggacaccaagaagtcgcaggacctggtcatgaagctgtcaaactcgatgaatgaagtagttcaaatcaccagcgtgctgacaatgatcaagccattcaagatcttcgagcacgagcttaataagcccataatgtccctgacaggaggactttcgtccacgaccagaaacgacgtcatgtggccaaagtcgggccaaggcctccgcgagtcatcagtcatgaagacattgcttgatgaacgccgtacttctggtacacaaccgacaacggcgccagtagccgcagaggaacccaggcttgagaacgttgccctggaaaatttcgttagtatcggctggaagctgttggacgattccgagttaggctggtat

SEQ ID NO: 198 - protein, 1170 aa, Saccharomyces cerevisiae
MNELNTVSTNSSDSTKNGGTSNSPDDMDSAAAASHAIKKRTKASRACDQCRKKKIKCDYKDEKGVCSNCQRNGDRCSFDRVPLKRGPSKGYTRSTSHPRTNEIQDHNNSRSYNTFDNSNNTLNNNTGNSGDNGINSNTVPSTPSRSNSVLLPPLTQYIPQAGGIPPSFQNPAIQSTMPAGNIGQQQFWKVPYHEFQHQRKGSIDSLQSDISVRTLNPNEQLSYNTVQQSPITNKHTNDSGNANGSVTGSGSASGSGGYWSFIRTSGLLAPTDDHNGEQTRRSSSIPSLLRNTSNSLLLGGQPQLPPPQQQSQPQAHQQKLQQGQNLYSYSQFSQQQPYNPSISSFGQFAANGFHSRQGSVASEAMSPSAPAMFTSTSTNPVNVAQQTQRPQGQQVPQFSSELDGNKRRQSAPVSVTLSTDRLNGNENNNGEINNNNGSNNSGSSKDTSQHSQESVTTPAALEASSPGSTPQRSTKKRRKSYVSKKTKPKRDSSISITSKDSAHPMTTSSTIAYGQISDVDLIDTYYEFIHVGFPIIPLNKTTLTSDLLLVNTQPISNIHEVNSYVILWFRNSLELLVRVALKQKPGGKFFDNIVGVALSPSNDNNKAGFTTATARDDAEKTRRDSHNEVQDTLEVQSVFIAALNECFQKIVDIHPKFRENNDQISPKIKVIYLSTFILLNYILAFVGYDNSFVLGMSVTIFNEFKLYKLLLFPEPDINDVKPPVDEEVSTGNGNTKTSEFEIGSESAGHMNPSNSPNSMDENISHYSVLFKRLYVLLSVFDSLQSCAFGGPKLLNISIQGSTERFFSNDLGSKWCLEQSQLRLKSVLQSLKLGELMSELTRNRISMNGNRKPGFDITNSSSLLSEYVETQPLSVAQLFCKLLIGKHNFINCLLSLYDSEAGVYSDLTLDLSSKIADSLCSLISIILQVLTLILRLNPTNSIDFNYRPPNPPANNPTVQEGPSAMGSSPVAGNLSAAPPSEGNPDFYKKLLGLKQDTGTILSDLCRGIISPFAIAILHEVYNITELVKQMPTSLISIMMTATTTQNTQDTKKSQDLVMKLSNSMNEVVQITSVLTMIKPFKIFEHELNKPIMSLTGGLSSTTRNDVMWPKSGQGLRESSVMKTLLDERRTSGTQPTTAPVAAEEPRLENVALENFVSIGWKLLDDSELGWY

SEQ ID NO: 199 - DNA, 3213 bp, Kluyveromyces lactis
atgttccactgtcatcgcgagaacattcaccagggcctcaattgcatacgcaacagagttattatggcaatggtactgacggagcgagcgaaagtgcacttacacagtcacgaaacaataatggggcgacttcagtggttgctatctcggatgctacgcaaaatggggaagatagtagtaaatatcagtaataatagtaatgccgtgtcgaaaggtaaagcagttgtcaacgctggtcatagaccggtgacgtcgtgtacgcactgtagacaacacaagatcaaatgtaacgcttcagagaagtttcctgcaccttgttcgagatgtgagagaatggggttgcactgtgagatcgatccacagttcagaccgaagaagggttctcagctacaaagtttgagaaatgacgtcgatgaattgaaagttaagatcgagtatttgaccagaaatgaaagtttgtgccaaggctctaaaacaaagcaatatagacagaatttgttgcaagctatcaaatctgttgatttttcatacagggtagcagggccgactcagggtcaagtagcgaagaataagatttcagtacaaacctaccttacgaatgaaccacagttactacaagactctcaaaccacaactacaaatccaaccacgtcctcaaattccaaagtggttacacccacaggatctgatcattctcctgccagtcataatggtggcagtctaagcagcggtaaaccgcagttgttgaatgattcagtacctgcaaatactaaagaccgtctccctccagttttgcagatcgctctgaaacgcctaagtcaacaaatttcttccagttcacctcagaatagtagtccaacaactacgggtcattcacctgctaatgatctttcttcaagcaaacaacatgttgttgcaacgactaatgcaatgccgttgttgccatctcctcacgctaatatcgacgagtttgtcttgggtgatgtccacatttctattgaaaaagccactgagttacacaacatttttgtcgccagatttttaccatactttcccataatgcaatcaaattcggcaactgagctatattctcagtcgcagcttctattctggacggtgatattaacagcctcattatcagaccctgaaccaacgttgtacaataaactttcttcactaataaaacaactcgccattgagacttgctggatcagaacgccaagatcaactcacatctcacaacgattgttaatactctgtaactggcctttaccaaaccaaaaggttttggatgattcgtcatacagattcgttgggttagcaaaatctctatcatttcaattgggcttacaccgtggtaagttcatgacagagtttaccagaactcaaacatcattgcccgaggccgaaaagtggagaacaagaacatggttaggtatatttttcgctgaacaattgtgggccagtatattaggtctaccaccgacctcacagaccgactacttgattgagaaggcaagactaggtgatgacggtgagctaccgccgattttaagaaagctaatctgtctagctaactttcaaggtaaactctgcaatgtaatgggtacaagtgttgtttctcctgatggcttgatggatgccagggagcgtgccggttctctagctatcttggaaagagagttagaaagacttgacgtaaaattgaagttccaagaggacgctgccgtcgaaatttactttttatacatcaagttaatgatctgctgctttgctttcctcccagagactccaactgaagatcagacgaagtatgtcacagaagcatatttatgtgcaaccaagataatcaccttattgacgaagttacttgaaactcagcaactaatcgagcttccaatttatatcagacacagtgcaacttattctgctctcatattattcaaactatatctaactccacttctcttggacaagtatgtggattccgcccgtcaatctattgtcacggtgcacaggttatacaggaatcaactgacggcttgggccgccagtgttgagaatgacatctctcgtactgctagtgttttggaaaaactcaactttgttttagtcactcatccggaagtattcatagaagaggagggtataatttcaagaatgagatcacatttgacaggtactttattctatgatttggtttggtgcgttcatgaggccagaagaagacagatggatccaaactatgatgctgaagctgctaaggaaaacaaagaaaaatggttcaagaacagaagaaagttatatccattgccattttataatcaaatttctaaagaggactttgagactattactcaaactacgcccggtgggactactgttacaacattggttccaactaagagtgctatcaagcaagctaagcagctagcacaatcacaaggagaccaaaatggcccagtcactcatattaatggtattccgttatctatgcttgacgagaccggtagtgtcaacattgaaggattattggccaatgcaaacctcaacctttcaaatgaacacagtactgtattggcttcttcttcttctactgctactaggttaaatgcagataacccaacaactgataccaacaagttcaatgttcaaaccgtgttcactcataatatcaaaaaatcttcaaaaagcagcgatacacctacgaacaaacctaaattcaattcaacttctagcattcccacagctacaccaacttctgagcaacgtgcagctcataataccaaaacttctgcaagcattttgactggtgatccaaactctcttttctctatgaacaattcattgcaagcgaacatccaactcaacaagacgctttcggctgattctaatggaacttccaataacaatattcctaattctacggcacccttgaatacaccagatactaatagttttaatagtttgaccagatcccctgatgccccatcttaccggaaacatgaacgtattttacaatgctgcaaaccagggtaccaatatgaataccttatattcacaatcggctacccaatgcacctcagggtatatcagctccgctatcagctcaaccggctcaatgtcacaaatatacctaacgggaacgtcaactcggaacttgatgattttttcctacgacagagctccggttggatcgaaggaaactctaga

SEQ ID NO: 200 - protein, 1071 aa, Kluyveromyces lactis
MFHCHRENIHQGLNCIRNRVIMAMVLTERAKVHLHSHETIMGRLQWLLSRMLRKMGKIVVNISNNSNAVSKGKAVVNAGHRPVTSCTHCRQHKIKCNASEKFPAPCSRCERMGLHCEIDPQFRPKKGSQLQSLRNDVDELKVKIEYLTRNESLCQGSKTKQYRQNLLQAIKSVDFSYRVAGPTQGQVAKNKISVQTYLTNEPQLLQDSQTTTTNPTTSSNSKVVTPTGSDHSPASHNGGSLSSGKPQLLNDSVPANTKDRLPPVLQIALKRLSQQISSSSPQNSSPTTTGHSPANDLSSSKQHVVATTNAMPLLPSPHANIDEFVLGDVHISIEKATELHNIFVARFLPYFPIMQSNSATELYSQSQLLFWTVILTASLSDPEPTLYNKLSSLIKQLAIETCWIRTPRSTHISQRLLILCNWPLPNQKVLDDSSYRFVGLAKSLSFQLGLHRGKFMTEFTRTQTSLPEAEKWRTRTWLGIFFAEQLWASILGLPPTSQTDYLIEKARLGDDGELPPILRKLICLANFQGKLCNVMGTSVVSPDGLMDARERAGSLAILERELERLDVKLKFQEDAAVEIYFLYIKLMICCFAFLPETPTEDQTKYVTEAYLCATKIITLLTKLLETQQLIELPIYIRHSATYSALILFKLYLTPLLLDKYVDSARQSIVTVHRLYRNQLTAWAASVENDISRTASVLEKLNFVLVTHPEVFIEEEGIISRMRSHLTGTLFYDLVWCVHEARRRQMDPNYDAEAAKENKEKWFKNRRKLYPLPFYNQISKEDFETITQTTPGGTTVTTLVPTKSAIKQAKQLAQSQGDQNGPVTHINGIPLSMLDETGSVNIEGLLANANLNLSNEHSTVLASSSSTATRLNADNPTTDTNKFNVQTVFTHNIKKSSKSSDTPTNKPKFNSTSSIPTATPTSEQRAAHNTKTSASILTGDPNSLFSMNNSLQANIQLNKTLSADSNGTSNNNIPNSTAPLNTPDTNSFNSLTRSPDAPSYRKHERILQCCKPGYQYEYLIFTIGYPMHLRVYQLRYQLNRLNVTNIPNGNVNSELDDFFLRQSSGWIEGNSR

SEQ ID NO: 201 - DNA, 3171 bp, Saccharomyces cerevisiae
atggtgaaggataatcgagattctgaccaagaccaagattttagttctgctcacatgaaaagacaaccggagcagcaacagttgcaacagcaccagttcccaagtaagaaacaacgaatatctcaccatgatgacagtcatcaaatcaaccatagaccagttacctcatgtacacattgtagacagcacaaaatcaaatgcgatgctagtcaaaatttccctcatccttgctccagatgcgaaaaaattggtctccactgtgaaatcaatcctcaattcaggcctaagaagggctcacagttgcaactactgagacaagatgtggatgaaatcaaatctaaactcgatactcttctggccaatgacagcgttttcgttcatcttttacaacagattcccatgggcaatagccttttgaataagctcaatctgcatccaactccaactccgggtactattatccctaacccagattcttctccttcctcaggttctccaacttcttccgcggctcaacgagattctaaggtttcagttcaaacttatttgtccagggaaccccaactcttacaagcaaatcagggcagcaatacgaataaatttaaagcaaataatgaagcatcttctcacatgacgttgcgcgcatcttctttagcgcaagattcgaaaggcttggttgcaacagagccaaataagctgcccccgctgctaaatgactcagcattgcctaataattcaaaagaatctttacctcctgctttgcaaatggctttttataagaacaactctgcaggtaacactccgaacggccccttctctccaattcaaaaaacatattcccctcatactacgtcgaccaccgttacaacgacaacaaatcaaccaccatttgcagcaacaagccacgtagcaacaaataacaatgcagataggacgaagacgccggtagtagccaccaccacgactatgccattattgccttcgccgcatgcaaatgtagatgagtttgtactgggcgatattagtatttccattgaaaaagcgaatagattacaccatattttcgtgactaggtatctgccgtattttcctattatgtattccaataacgccaccgaattatactcccaatctcagttgcttttctggaccgtgatgttgacggcatgtctgtctgatcctgaaccgacgatgtattgcaagctaagctctttgatcaagcaacttgccatagagacctgctggataagaacacctagatccacacatatttcgcaagctttgttaatattgtgcatttggcctttgcctaaccaaaaagtcctagatgattgttcttaccgttttgtaggattagcaaagtcactgtcttatcaattaggtttgcacagaggtgaattcatttctgaattcacaagaactcaaacatcaatgccaaatgcagaaaagtggagaactaggacttggctgggaatattttttgccgaactttgttgggcgagtatccttggtttgccaccaacttcacagacagactatttattagaaaaagccttatcctgtggtgacgaagaatcagaagaagataacaatgacagtattgacaataacaacaatgataaaaggaacaagaaagacgagccgcacgttgaaagtaaatacaaactaccgggcagttttagaagattgctcagcctggcgaatttccaagcaaaattgtctcatatcattggttcttccacttccagtcctgatggtttattggaaccaaagtatcgtgctgagacactgtccatcttgggaaaagagttagatttattagcaaaaactttaaatttccagagtgacgatactgtcaacatttattttctttatgttaaattaactgtctgttgttttgcattcctacccgaaacacctcctaccgatcaaattccatatgtcacagaggcctatctaacagctactaaaattgtcactctattgaataatcttttagaaacacaccaattaattgaactgcctatttatattagacaagctgctacattttctgcactgattctctttaaattgcagttgactcctttacttcctgacaaatattttgattcagcaaggcaatccgtggtcactatccatagactttatagaaatcagttaactgcgtgggccactagtgttgagaatgatatttcgagaactgcaagtatgttagaaaaactgaacttcgtactgatcatgcatccagaagtttttgtggaagaagacggtattatttctaggatgagatcacatttaacagggtctctattctatgatttggtttggtgtgttcacgaggcgagaagaagggaaatggatcccgaatataacaagcaagccttagagaaagccgctaagaaaagaaaattttcctcaaatggtatctacaatggcacttcgtctacgggtggcataacggacagaaaactatatccattgccactatataaccatatctccagagatgactttgaaactgtaacaaaaacaacaccaagtggaaccactgttaccactttagttcctactaagaatgccttaaagcaggcagaaaagctagccaagacaaataacggagattctgacggttctataatggagattaacgggatacctctttccatgctcggggaaacaggcagcgtaaaatttcaaagtttattcgctaatacctcgaatagtaacgattataataataataggacgttattggatgcgtctaatgacatatcaattccctctaattcaatttatccagtggcttctgtccccgcttcgaataacaatccacaaagtactaaggtagactattatagtaacggacctagtgtaattcctgatctctccatgaaaagatcagtaagcactcccgttaatcattttcctgcgtccgttccagggttaaggaaccaccccgttggcaacttatctaataatgttacattgggaatagaccaccctattccaagggagcacagtaatttacaaaatgtcaccatgaattataataatcaattcagcaacgccaacgcgattggaagatcacaaagtagtatgtcccattcacgtacacctttgtttcggtcaatatatgacagttggattccgcgtccgaccccggtcctc

SEQ ID NO: 202 - protein, 1057 aa, Saccharomyces cerevisiae
MVKDNRDSDQDQDFSSAHMKRQPEQQQLQQHQFPSKKQRISHHDDSHQINHRPVTSCTHCRQHKIKCDASQNFPHPCSRCEKIGLHCEINPQFRPKKGSQLQLLRQDVDEIKSKLDTLLANDSVFVHLLQQIPMGNSLLNKLNLHPTPTPGTIIPNPDSSPSSGSPTSSAAQRDSKVSVQTYLSREPQLLQANQGSNTNKFKANNEASSHMTLRASSLAQDSKGLVATEPNKLPPLLNDSALPNNSKESLPPALQMAFYKNNSAGNTPNGPFSPIQKTYSPHTTSTTVTTTTNQPPFAATSHVATNNNADRTKTPVVATTTTMPLLPSPHANVDEFVLGDISISIEKANRLHHIFVTRYLPYFPIMYSNNATELYSQSQLLFWTVMLTACLSDPEPTMYCKLSSLIKQLAIETCWIRTPRSTHISQALLILCIWPLPNQKVLDDCSYRFVGLAKSLSYQLGLHRGEFISEFTRTQTSMPNAEKWRTRTWLGIFFAELCWASILGLPPTSQTDYLLEKALSCGDEESEEDNNDSIDNNNNDKRNKKDEPHVESKYKLPGSFRRLLSLANFQAKLSHIIGSSTSSPDGLLEPKYRAETLSILGKELDLLAKTLNFQSDDTVNIYFLYVKLTVCCFAFLPETPPTDQIPYVTEAYLTATKIVTLLNNLLETHQLIELPIYIRQAATFSALILFKLQLTPLLPDKYFDSARQSVVTIHRLYRNQLTAWATSVENDISRTASMLEKLNFVLIMHPEVFVEEDGIISRMRSHLTGSLFYDLVWCVHEARRREMDPEYNKQALEKAAKKRKFSSNGIYNGTSSTGGITDRKLYPLPLYNHISRDDFETVTKTTPSGTTVTTLVPTKNALKQAEKLAKTNNGDSDGSIMEINGIPLSMLGETGSVKFQSLFANTSNSNDYNNNRTLLDASNDISIPSNSIYPVASVPASNNNPQSTKVDYYSNGPSVIPDLSMKRSVSTPVNHFPASVPGLRNHPVGNLSNNVTLGIDHPIPREHSNLQNVTMNYNNQFSNANAIGRSQSSMSHSRTPLFRSIYDSWIPRPTPVL

SEQ ID NO: 203 - DNA, 2487 bp, Saccharomyces cerevisiae
atggccaagaggaaatatggcaggtcttattccctcgatgatacagattcctgcagcaataaagtcctgatagtaccaaccggtcaaagctcctctaacgcaatcactgatttctctgtcagaaaggcgcatgcttgcgatagatgcagactgaaaaaaatcaagtgtgacggtttaaaaccgaactgttcaaactgtgcgaaaattgacttcccttgcaaaacctcggataaactgtcgaggagaggtcttccaaaggggtatacagaactactagaaaaagaggtcgtccgtttgacaaatatgaatgcgagttccagcgccaatgcaaattctaatttgccgttcattaatgatacattttattgttttgataattacaacactcagtctgaaaatcaaaggtttttgggacatttgacatggaatattctaactaatacttttcctactcaaaaagcagtagtttttacagacgatcgaaataatattgatctacaactgcaactgttaacaaattttttgaacctgaatggtgactttaatcatctcccaaattttcttttacttaaatatgattataaccttcagtttttgaaaaatttgttgtctgtcattattaaagatttttttaaaaggcaaaattctttgctacttctattataccctacaaatttatggaaaaatttgctattagacaagattaattcaaccgcaatgacaggtgaacccataactctactggcgttactttatattattcaatttacttggtcttgttttgatgatttcaagctttttaaagtcacgaagcttattgtttctctgacaacaaacagcaaattagacttgaaagttttgcaattggttaacttatccatcttttattttatgggcgcctctgttgactcttgtaaaagtaaaagctcgttaacagaacattcaaatgtaaattcagtaatatggaccaatgatttgctaaacctaaactttacaaatattttgaatatgggattgtacataaatcccaaaaatttaattcctatatcaggcaacaataataataataaatctaatgaagaggatgatagaatagtgacattttggtgctttcaattcttaagctcatggtggtccttaattcaaggtttaccaaagtccaactttttaactgaagaatttcaaccgaaatcaatctcggttctagaaatccccaggctgaagccctttgaaattttgttaaacttcatcatatattctttggatggatgtaatttgttgaatatctcatctttaaatgtttcggacccaaatttccaatttttccagaatgaactggaaagctttaaaaaaaatttattactgtggaacctttatcacaatttgagtgatcacgataacttccgattcttaacatccagttcaaataaaaaactaacaacaaatttactacttaagaatttgacgggtctaaatcacaaactcaatcaacctgattttgtggagattcaattaactttattttacttgagtttaaaattaatgactttaaaggaaggggaccaagatttgaagaaagaggatatctcgttagagatattgtccctatattttttaattcttacagatgactctaataatgatgataatcaacagttacaaccacagcaactaaatctctaccattttacgcccttcaatagtattgacattattgacttatgtttaaacaatttaaacaattggtcattatcacttaaatacgaaagtggtcaaaaccagccccactcaagtaaaataaagtttgaaaaatttcaaaactttttaaatcactggtgtccaatatggtactatgatgaattttccacaaacccttttttacaaatcctcaaaatcaatttcaaattacttccttttgagacaatccattactcacaagaagagcaacgattgttaataagtttgaataaattgagatatttggatgccgtatcgagctttaattcaagttcagtcaagtcgaatttcgcgtctaaggtcaatacccagctaaaccttttgcaacactcgagttctaactccaatttcctagatgcgtcaccatacgattttaataaaatttttatgaacaactttgaaaactatgactacgaaacagatgaaggatatgcggaagatgatgatgaagaggatagtgacagtgacaatagcttaccactagaaattccttttaaaaaaagtaaaaataaatgcaagaataggaataaagagctttcacaaaggttatccctatttgaaaacagagatagcaattcggtagatttcaacacagatacaaatttaaatttaaaccctgattcgccatcagttacgtcttctaagaaaaaatatttagatcatattattttagataaccgagacatcgttagcaaccatgactccagtaaacaaaaattcaagatccagaatattttgaactcgaccttc

SEQ ID NO: 204 - protein, 829 aa, Saccharomyces cerevisiae
MAKRKYGRSYSLDDTDSCSNKVLIVPTGQSSSNAITDFSVRKAHACDRCRLKKIKCDGLKPNCSNCAKIDFPCKTSDKLSRRGLPKGYTELLEKEVVRLTNMNASSSANANSNLPFINDTFYCFDNYNTQSENQRFLGHLTWNILTNTFPTQKAVVFTDDRNNIDLQLQLLTNFLNLNGDFNHLPNFLLLKYDYNLQFLKNLLSVIIKDFFKRQNSLLLLLYPTNLWKNLLLDKINSTAMTGEPITLLALLYIIQFTWSCFDDFKLFKVTKLIVSLTTNSKLDLKVLQLVNLSIFYFMGASVDSCKSKSSLTEHSNVNSVIWTNDLLNLNFTNILNMGLYINPKNLIPISGNNNNNKSNEEDDRIVTFWCFQFLSSWWSLIQGLPKSNFLTEEFQPKSISVLEIPRLKPFEILLNFIIYSLDGCNLLNISSLNVSDPNFQFFQNELESFKKNLLLWNLYHNLSDHDNFRFLTSSSNKKLTTNLLLKNLTGLNHKLNQPDFVEIQLTLFYLSLKLMTLKEGDQDLKKEDISLEILSLYFLILTDDSNNDDNQQLQPQQLNLYHFTPFNSIDIIDLCLNNLNNWSLSLKYESGQNQPHSSKIKFEKFQNFLNHWCPIWYYDEFSTNPFLQILKINFKLLPFETIHYSQEEQRLLISLTKLRYLDAVSSFNSSSVKSNFASKVNTQLNLLQHSSSNSNFLDASPYDFNKIFMNNFENYDYETDEGYAEDDDEEDSDSDNSLPLEIPFKKSKNKCKNRNKELSQRLSLFENRDSNSVDFNTDTNLNLNPDSPSVTSSKKKYLDHIILDNRDIVSNHDSSKQKFKIQNILNSTF

SEQ ID NO: 205 - DNA, 2847 bp, Saccharomyces cerevisiae
atgagtatcaatcatgaaatatattatatacttgtatttgagcatcgttcagtagcaatcaagctcatcatcgtagtgattgttctccttcagttttttttagcacgaagtcggcaaattgataggacatgggcccatactaatagaaaggaacggttcagagaaatgacagctatcgggaatactgatgatgcacttgatactagtacagccgcaagtaaagaaaatggaaaaggtagactcagggttcaaaaagcttgtgaactttgcaagaagagaaaggttaaatgcgacggtaacaatccttgtctgaactgctctaaacatcaaaaagaatgccgttatgatttcaaagctacaaaccgtaaaagaagaagacgacaggtcgcatcagctgttcgggacgttagtaagacatatgcagaaaccagtgagtcttttcctagggacttgttaagtaaatcaaatattatcataaatgccccctcagatggtgtatcttcgtctgctagcaactctcccaatccaaattcacattatcatcatatatcatccactttacccttcatgagcggtaggccaaaccatacattccattccggaagcaacttaaatggagaaaataacaataacagttttccggaggatcacatggctaaattacttctgcaattgagttcaaaattggggaatacgaccaaggaatcgtcaattagaacaactagaaccaatgctagtgatgtgaatgcaaacccgacagtggtcaacatgaaaaatagtcaggaagactgtgacacgaatcacaggtctgcaatatgtgactctgcagaggctcttcataataacaacatcaattctaaagagaataagataatcaactctcaaataactaacactgttaatgatcactttgaatcaccctggcagacattttctttagataagtataggtttcaccgacgctaccaaaatattctgccctattaccttggtgtatctattttaaaggatctatctccgcagacaatagagtacgcgaagttgaaaaggccaagagttcaaaactatggttggaacttgtcaggaggccattacttaaagtataagggtgactttagaagccaagaaaaaaatataaggcatgagtctaaatttttcgactttgatgaccctgttcacttatccttaatcaataagttactaaggtattattttgatgagatcaatcctgttttcagtatcattcacgaagcgacattttggcagcaatataacaataaatttctacggcaaggtaaacaaaataattcatctgcgaatctattcacttccatgctttatctaattttgtctactacactaagattcagagaagggcatctagatggtcagaaagggcaaggaacctacagtaacacatccttaaatatcacattcgaggaaaaatctattttgatcaaaaaaccctccatagaggaaaatttattcaaatacgcttatttaataatcaacacgctgacctttgagtgggaatcattcgaactaatacaatcgtggcttttgataaccttctatttcagaacctgttacagacagacggcgtgctggaacgcgttaagtcaagcggtgaacatgtgtaatgggatgagtctatatttaaacaaatttcctgagatccattccacttatgatgaatcaaaagcatggcattgtttctggtgttgttttataatggataagttgataagttttcaaatgggtcgattctaccaactatcattacccgcgagcgagatgtgcgaacagatgaatctagtgaagtcaaagaaatttttacaagaagaagatgattggtttcacgaagagacttttcaaatgcttgatttgtccataatagtgacacagtttttaaaaagagacgcacaggatttaaatttgaacgagaccgtgcaattgcgcagccaacttggtcaatggtatgacacctttatagttggaagtcaaaccaatgcgtacgacgacaattatcgttacttctatcaagttcaaccattcatgacatacctggatataaggctgactttcgaagtaagacaattattttgtctaatcgccccctcatctaccgcaaataataaatccctagaatatgtcgtcgatactgaattgttaatttctcattgtcaaatggctattgaaaatttggctgaaattacgagaagtaatcttttctttgttccgtggtggttaaacctttctcaactattcacggtaaatttaatatgtattatctacctgcacgcagggattgccgtaactcaaaataaagctatcatgcaaagctgccaagaaatatggcgaaccttagagtgctctaagccaaaaaatcggccttcaatgcttcctgagtgcttgtggtgtttgaaaatgctgaatcatatgttctgcatacgactgagagattctgctttgcaattggaagctactctcggaactgatcatggtgatgacacccctaatagaaataagtttgagcagttcaagaaagttggcgataatgatgcggatgttgaagttgatgctggtgaaagagaagaaaatgctgatgaaagacaagaaaatccacataacaatagcaaaagagtaccattagctactaggtctcataataccactaacttcgacggttcaatcgcaatttctccggaaagtgcagtagcaaatctaggtactgatactggattgccctcagatgttcttgatactgtcagtaaaatagggaactctcctaatgtgtttgatgatgatttattttccaatttattatggtttgaccaaaattttgca

SEQ ID NO: 206 - protein, 949 aa, Saccharomyces cerevisiae
MSINHEIYYILVFEHRSVAIKLIIVVIVLLQFFLARSRQIDRTWAHTNRKERFREMTAIGNTDDALDTSTAASKENGKGRLRVQKACELCKKRKVKCDGNNPCLNCSKHQKECRYDFKATNRKRRRRQVASAVRDVSKTYAETSESFPRDLLSKSNIIINAPSDGVSSSASNSPNPNSHYHHISSTLPFMSGRPNHTFHSGSNLNGENNNNSFPEDHMAKLLLQLSSKLGNTTKESSIRTTRTNASDVNANPTVVNMKNSQEDCDTNHRSAICDSAEALHNNNINSKENKIINSQITNTVNDHFESPWQTFSLDKYRFHRRYQNILPYYLGVSILKDLSPQTIEYAKLKRPRVQNYGWNLSGGHYLKYKGDFRSQEKNIRHESKFFDFDDPVHLSLINKLLRYYFDEINPVFSIIHEATFWQQYNNKFLRQGKQNNSSANLFTSMLYLILSTTLRFREGHLDGQKGQGTYSNTSLNITFEEKSILIKKPSIEENLFKYAYLIINTLTFEWESFELIQSWLLITFYFRTCYRQTACWNALSQAVNMCNGMSLYLNKFPEIHSTYDESKAWHCFWCCFIMDKLISFQMGRFYQLSLPASEMCEQMNLVKSKKFLQEEDDWFHEETFQMLDLSIIVTQFLKRDAQDLNLNETVQLRSQLGQWYDTFIVGSQTNAYDDNYRYFYQVQPFMTYLDIRLTFEVRQLFCLIAPSSTANNKSLEYVVDTELLISHCQMAIENLAEITRSNLFFVPWWLNLSQLFTVNLICIIYLHAGIAVTQNKAIMQSCQEIWRTLECSKPKNRPSMLPECLWCLKMLNHMFCIRLRDSALQLEATLGTDHGDDTPNRNKFEQFKKVGDNDADVEVDAGEREENADERQENPHNNSKRVPLATRSHNTTNFDGSIAISPESAVANLGTDTGLPSDVLDTVSKIGNSPNVFDDDLFSNLLWFDQNFA

SEQ ID NO: 207 - DNA, 2229 bp, Saccharomyces cerevisiae
atggatggtcccaattttgcacatcaaggcgggagatcacaacgtactactgaattgtattcgtgcgcacgatgcagaaaattaaagaagaagtgtggtaaacaaataccgacatgtgcaaactgcgataaaaatggggcacactgttcatatccaggtagagccccaagacgtaccaagaaggagttagcggatgctatgctacgaggggaatatgttccagtgaaaaggaacaagaaggtaggaaaaagcccattgagcactaagagcatgccaaactcttctagtccgctatccgcaaatggcgctataactcccgggttttcgccttacgaaaacgatgatgcacataagatgaaacagctaaaaccgtcagatccaataaatcttgtcatgggggcaagtccaaattctagcgaaggtgtctcatcgctaatttcggtgctaacatcgctgaatgataattctaatccttcttcgcacttatcctctaatgaaaattccatgattccttcccgatcattgccagcttccgtgcagcaaagttcgacaacttcatcattcggaggatataacacgccttcaccactaattagcagtcatgtgcctgcgaacgcccaagccgtaccgctacaaaacaacaatcgcaatactagcaacggggataacggcagtaatgttaaccacgataataacaatggcagtaccaacacaccgcaattgagtcttaccccatatgcaaacaattcagcccccaatgggaaattcgattctgtgccggttgatgcatcctcgatcgaatttgaaactatgtcctgttgctttaaaggtggtagaacaacatcgtgggtcagagaggatggctcgttcaagtcaattgatagatccttactggacaggttcattgccgcatacttcaaacacaatcaccgtctatttcccatgattgataaaatagcattcctaaatgacgccgcgacaattactgatttcgaaaggttatatgacaacaaaaactaccctgacagctttgttttcaaagtatacatgatcatggctattggttgtacaactttacagcgtgctggtatggtttctcaggacgaagagtgtctgagtgaacatttggcttttttggccatgaaaaaatttcgtagtgttataattttacaagatatcgaaactgtacgatgcctattgttgttgggtatttattcgttttttgagccaaagggctcctcgtcatggacaattagtggtatcatcatgcgattgaccataggattaggtttaaatagagagttaactgccaaaaaactcaagagcatgtctgctttagaagcagaggcaagatatagagtgttttggagtgcttactgctttgaaaggctagtatgcacctcgttgggccgtatatccgggatcgacgacgaagacatcactgtgccactaccgagggcgttgtatgtggatgaaagagacgatttagagatgaccaagttgatgatatcattaaggaaaatgggcggtcgcatttataaacaagtccactctgtaagtgcagggcgacaaaagttaaccatcgaacaaaagcaggaaatcataagtggattacgcaaggagctagacgaaatttattctcgagaatcagaaagaaggaaactgaaaaaatctcaaatggatcaggtggagagggagaacaattctactacaaatgtaatatccttccatagttctgagatttggctagcaatgagatactcccagttgcaaatcttactatacagaccatctgcattgatgccaaaaccgcccattgactcactatccactctaggagagttttgcttgcaagcctggaaacatacttatacactgtacaagaagcggttattacccttgaactggataacccttttcagaacattaaccatttgtaacactatcttatactgtctttgccagtggagcatcgacctcattgaaagtaaaatcgaaattcaacagtgtgtggaaatactaagacatttcggtgaaagatggatttttgctatgagatgcgcggatgttttccaaaacattagcaacacaattctcgatattagtttaagccatggtaaagttcctaatatggaccaattaacaagagagttatttggcgccagcgattcatatcaagacatattagacgaaaacaatgttgacgtctcttgggttgataaacttgta

SEQ ID NO: 208 - protein, 743 aa, Saccharomyces cerevisiae
MDGPNFAHQGGRSQRTTELYSCARCRKLKKKCGKQIPTCANCDKNGAHCSYPGRAPRRTKKELADAMLRGEYVPVKRNKKVGKSPLSTKSMPNSSSPLSANGAITPGFSPYENDDAHKMKQLKPSDPINLVMGASPNSSEGVSSLISVLTSLNDNSNPSSHLSSNENSMIPSRSLPASVQQSSTTSSFGGYNTPSPLISSHVPANAQAVPLQNNNRNTSNGDNGSNVNHDNNNGSTNTPQLSLTPYANNSAPNGKFDSVPVDASSIEFETMSCCFKGGRTTSWVREDGSFKSIDRSLLDRFIAAYFKHNHRLFPMIDKIAFLNDAATITDFERLYDNKNYPDSFVFKVYMIMAIGCTTLQRAGMVSQDEECLSEHLAFLAMKKFRSVIILQDIETVRCLLLLGIYSFFEPKGSSSWTISGIIMRLTIGLGLNRELTAKKLKSMSALEAEARYRVFWSAYCFERLVCTSLGRISGIDDEDITVPLPRALYVDERDDLEMTKLMISLRKMGGRIYKQVHSVSAGRQKLTIEQKQEIISGLRKELDEIYSRESERRKLKKSQMDQVERENNSTTNVISFHSSEIWLAMRYSQLQILLYRPSALMPKPPIDSLSTLGEFCLQAWKHTYTLYKKRLLPLNWITLFRTLTICNTILYCLCQWSIDLIESKIEIQQCVEILRHFGERWIFAMRCADVFQNISNTILDISLSHGKVPNMDQLTRELFGASDSYQDILDENNVDVSWVDKLV

SEQ ID NO: 209 - DNA, 1503 bp, Candida albicans
atgtccaaaggtaaaagagcaccttatacacggccctgcgattcttgcagttttcgaaaagtcaagtgtgatatgaaaaccccatgttccagatgtgtccttaataacttgaaatgtacgaataatcgaatacgaaaaaaatgtggtcctaagaagatccgtgatagaactcgagaagcaattaataatctaagtaataaagaagatcccaaaacaaattcatttatcccgcatttccagttggacaagttacagccctgtttggagacatatcaaacttggtattatggaatttggccggtcttgtcgatctcagatttgaatatgaaaattactaaacgagatgtgtcagcttatgcacttgcctgtgcattaagtgcagcaatactcaatcaaatagattttattagtaacaatgggacctattgtatccccgaagacgttaagaaattggactttattggtgaatgtattcgagctcgcacgtttatgaattatcaaatgactcccacccttgagacaatattgacatcattttttttacatgtggctgaagtgaataaaggtagcaaaccagcggcaattatttatttgagagaagctatcacaatggctcagataattggactacataatgaatcgacatataagctgaaaccagttgctgaagcacatcgaatgagaaaaatatattttatgttaatggtcacagaaaggtttatgtgtattgacgatttgatccctgttgttcttgaaaactcgatcaaagagttttcgttggatgatgaacaatattcagtattaattgatggattcaaagagttggtcaaggttttctccatccctctgaaagccattttcgacagatttatacaaatgaatgattcaatatccatgcctccagagaccgctgggttactcaacaaaatacaactagaactagagtctatttgtatatcaccagtggcaccagatatccaaaaggcaaatataatagttagtaaatattggatgaaggcgttgacttggaaaattacacgaaaaaacaacttattagatgactttgtgactacattatgtgtcaaatatccaatagagttatctgaacaatttcttggagaaatcaagagtatacctttgagagcatttgaatcaaatggacctggggtggtattcaagttattgctgatagcaactgtcttaattgactcaattaatttaagcaatgatgtctcaggttatgaatcattacagcgcatgtttgatttgatttcgaaattgaaaaagacagatatgatcattccacgacgagaatatgatagaataaaagaagcattaactaaaatggaaatagatattttcttcagcagtgcccaactgggcggctacatttccgaagtggaatcaaatggctcattggacgcctttcttactgatccgcttgtattttattcaggaagcaatgataatcctactcccagttacataccagattatcaaaaa

SEQ ID NO: 210 - protein, 501 aa, Candida albicans
MSKGKRAPYTRPCDSCSFRKVKCDMKTPCSRCVLNNLKCTNNRIRKKCGPKKIRDRTREAINNLSNKEDPKTNSFIPHFQLDKLQPCLETYQTWYYGIWPVLSISDLNMKITKRDVSAYALACALSAAILNQIDFISNNGTYCIPEDVKKLDFIGECIRARTFMNYQMTPTLETILTSFFLHVAEVNKGSKPAAIIYLREAITMAQIIGLHNESTYKSKPVAEAHRMRKIYFMLMVTERFMCIDDLIPVVLENSIKEFSLDDEQYSVLIDGFKELVKVFSIPSKAIFDRFIQMNDSISMPPETAGLLNKIQLELESICISPVAPDIQKANIIVSKYWMKALTWKITRKNNLLDDFVTTLCVKYPIELSEQFLGEIKSIPLRAFESNGPGVVFKLLSIATVLIDSINLSNDVSGYESLQRMFDLISKLKKTDMIIPRREYDRIKEALTKMEIDIFFSSAQSGGYISEVESNGSLDAFLTDPLVFYSGSNDNPTPSYIPDYQK

SEQ ID NO: 211 - DNA, 897 bp, Saccharomyces cerevisiae
atgtccacaagcattacagtaagaaatagagatcgatcgctaccaccgctattgctccccaatgtttccctgctagaaaaagatatacggcgtaaaggcacccaaaatgtgggcatcaccgatccagaactcttgtcgaccacttggacgaggaagcgggcttttccgactgacgagcttttaggaggctataagagattaaagcctgctgccgctgacagtaatgagtgcgctattggtattgccacggtgacgccgccgccaacgctccccgtaagtgcgattgttccccctccacaaaattacactccaccattgtttgagtatcatcctcatgctcttgcttccatggtcaatgaagacgctaatgcgtcatgcactcaaatgtctataatttcgcgctcaacgagcaactcgacaacctcctctgccacatctactagttcaatttccaagagacaaagaagtggcccaagttgtgacaaatgtcgtttgaaaaaaataaaatgtaatgcgaaaattgagattttgcttcaagacgatactataatgccaatgatctcgaacaagttgcggtacgtcttgactcctgacgatattcggctatatcgaggcacgctgttgcggaatattgccataccggatgatgtcattgagggtacaggctcacgcaagttgattaagcatattgataagttggttttgctcacaccttgtttaccatgcattaagaaaaagcattcttcttcttccactaatttcccaaaaaatgataaatgtactttttcaaaaggctttaccagagctgacataaacatttcatccaaaatctccttaaaatttaaggataaaaccatttacgacataacctatgatgactataaaagcattgatttt

SEQ ID NO: 212 - protein, 299 aa, Saccharomyces cerevisiae
MSTSITVRNRDRSLPPLLLPNVSLLEKDIRRKGTQNVGITDPELLSTTWTRKRAFPTDELLGGYKRLKPAAADSNECAIGIATVTPPPTLPVSAIVPPPQNYTPPLFEYHPHALASMVNEDANASCTQMSIISRSTSNSTTSSATSTSSISKRQRSGPSCDKCRLKKIKCNAKIEILLQDDTIMPMISNKLRYVLTPDDIRLYRGTLLRNIAIPDDVIEGTGSRKLIKHIDKLVLLTPCLPCIKKKHSSSSTNFPKNDKCTFSKGFTRADINISSKISLKFKDKTIYDITYDDYKSIDF

SEQ ID NO: 213 - DNA, 2217 bp, Aspergillus nidulans
atggctgctgttatcacgctccagtcgtcctcgacggctggtctccaacagggctctccatctgaccgtcatctccttcggccgctgctgcagaataaccctcagcaaccgccgctacagcagcagccgcttcaaccacagcaatccccctctcctgcccccattggcacccttcctcgtcttcctgcactgggccgggatggaccgagttgtgacgcctgtctgcgcagaaagagtcggtgtgctatgaacgaaatggtcaacaagtgttattcgtgcgactttcatcgccaggactgcaccttcaccctatcatcatcgtcaaccaccacaacaaccattaccacgaccgcgaccagcgcgaacagcgcgaacagcgccagcagtgccagcactgccggcaccagccgtccaagcacggctgacgtgcagtctaaaaagcgtaaactggacgatatcatcaatagtgatgcggattctcctaaaaggttatcgaccgtttctaaagctgacagtgctcgttcgcccttgagtgaacacccgcggttcaacgccgtctcatactggcatcagaccacccagcacatcggcctcactaccgagctggagcccgccctactggcctaccttccggtagaccagaacgacgagagtatcgttgctgcttcgcgggtacggaaactcagcgacgacggcacttttatgcgtgtcgtcaacaccatgtcgcatgcggatgctccgcagtccgccaccctggtctccatcgagagcctggttgctccctatgggtccaccttggtagagaagttcttcgagcacatccacccgaccttcccaattctgatggaagatgtcttccgccagtcgtacagaaccaggaatggcatctctccacttttactttctgctgtctacgtcctggccctcaagtttgttgacatcggaccagcctcgcagtccgcgcggcggcccgacgccactcgtcttgaggccactgctttgaggcttcttaatgaatctctaccatatgcatcaatatcgacgatccaagcggggctgttactcatgcaaaagtcgacgttggcaaccgctgctttgaacgcgcaattggtcaccgctgggtttgagctcgggcttcaccaggattgctccgactggcggatggaaacctgggagaagggcctgagaaagcgtctcgcctgggcactttacatgcaggacaaatggtccgcaatggtgcacggccggccatcacatgtcgtttcctccaactggactgtgcaggatctcgtggaagaagattttactgacgcgttcgcctcgaccgcatcccagccggaagacgcccctgtaggccacgggccgcttttcttctgtcatctagtggccctgaccaccattctctccgatatcctggaccgcttttacaccctccagtcaatacaagaatttaaagccgcgggcagcaaccgaacccgtctcatcctagaacgcgccaaaccggcccaaatccgtctcaaggaatggttcgcgcgtctacctgcatccctcaaactagactctaccaccgacctctttgagaacatcacggaggaaaatgcccgcaacggcgccctgcacctctcctacttcgccaccgaaatcactctccatcgctgcatcgtccgctccctctctccagattccacggacgcctacctctcccacatctgccgctccgccgcaaagacccgcctcatctcagcaatggactttgtaaaccgtctccgcccgcctcaccttcgctccttctggcccgccgcatccagaacccactttgccctcatcggctcgttcggcatcctcctacgtgtaacagcgccgaccaaagaagaagccgagttctaccgccttcggctctgcgagtaccgctggaccctgagcgtcagcaaaaaggacgccgaattcctcgagtttgcgctcgagtctctagacaacgcaacggatctagatcatcatgtccctgctaaaccaggaatcgatgagctgatgaccagctcgtcaaaaccatacattgcttctacttcggccagatcggggacgacgcaggaagaggcgattctggatttggacccgcgctctgggaccggaggcacctcctctgttatctcggggctggcttcaccggctacctcggttagtgaggaaagtatgcacgatgcggctgttgctccgatg

SEQ ID NO: 214 - protein, 739 aa, Aspergillus nidulans
MAAVITLQSSSTAGLQQGSPSDRHLLRPLLQNNPQQPPLQQQPLQPQQSPSPAPIGTLPRLPALGRDGPSCDACLRRKSRCAMNEMVNKCYSCDFHRQDCTFTLSSSSTTTTTITTTATSANSANSASSASTAGTSRPSTADVQSKKRKLDDIINSDADSPKRLSTVSKADSARSPLSEHPRFNAVSYWHQTTQHIGLTTELEPALLAYLPVDQNDESIVAASRVRKLSDDGTFMRVVNTMSHADAPQSATLVSIESLVAPYGSTLVEKFFEHIHPTFPILMEDVFRQSYRTRNGISPLLLSAVYVLALKFVDIGPASQSARRPDATRLEATALRLLNESLPYASISTIQAGLLLMQKSTLATAALNAQLVTAGFELGLHQDCSDWRMETWEKGLRKRLAWALYMQDKWSAMVHGRPSHVVSSNWTVQDLVEEDFTDAFASTASQPEDAPVGHGPLFFCHLVALTTILSDILDRFYTLQSIQEFKAAGSNRTRLILERAKPAQIRLKEWFARLPASLKLDSTTDLFENITEENARNGALHLSYFATEITLHRCIVRSLSPDSTDAYLSHICRSAAKTRLISAMDFVNRLRPPHLRSFWPAASRTHFALIGSFGILLRVTAPTKEEAEFYRLRLCEYRWTLSVSKKDAEFLEFALESLDNATDLDHHVPAKPGIDELMTSSSKPYIASTSARSGTTQEEAILDLDPRSGTGGTSSVISGLASPATSVSEESMHDAAVAPM

SEQ ID NO: 215 - DNA, 3282 bp, Saccharomyces cerevisiae
atgaatatggattctggtattacaagtagtcatggaagcatggataagacacaaaagcaaagttctgagtgggcagctaaccagaaacataatcaaagagtcgaaaatacaagagttttaatgggccccgctgtccctgcgatgcctccagtaccatcaaattttccgcctgttccaactggtacaataatgtcgcctcagttgagcccttttccggatcaccgtttaagacatcacccattagctcatatgatgcctgctgataagaattttctggcatataacatggagtctttcaaaagtagagtgactaaagcatgtgattattgtcggaagaggaagattagatgtacggaaatcgagccgatttctggtaaatgtagaaactgtatcaagtataataaagattgcacgtttcatttccatgaagaactgaaaagaaggcgagaagaagctttgaataacaagggaaatgggaagtcggttaagaagccgaggttggataaggagaataagttcaaggatgaaaattttgatatcgccgtgcgatcaagaaatacttcttctacagacagctcgccgaaattacacaccaacttatcacaagaatatattggagtttctgccggcaaaagtgcaagcgataaagaagatacttggcctgactttgttcctattgacaggacagtgcttgaaaaaattgaactcaaccatacgaaggttgctgggaaagtttttgttttggaagagatttgtaaaaacatgaagggaacaatagagaagctagctgaaaaaagcaaaattgacgtcattgataaagaatacatgaaaaggcctaaaagaaagcaatattcaaaggccttgttaacaaaacaaaaaatgtttcattttcgacaaaatgttttatcacatttaactgacgaagaatttctttcgcccattaatgaaatgtttactactactttcaaatattctattttacagaccaagctggtcctggacttctctttccgatccgcatcatcaccatctagtgataatattttgtatcctctgccccgtttagcaattgcaaagcgtttgctcaaaaatataaaatgtccatcattagcctctcttctccacatagtggatgtagatcaatgtttgcaatttgccgacgtgcactttgatcctgctaaaggaagattgacatcatcacaggcatttttgctaaatatctgcctctgccttggggccaccgttacaaattttgaggagaagcaggagctagttgatgaagataatcatgaaacctattattttgagaagttcgaattatggagactcagatctttcacttttctcaattctgtctattactaccataaactgtctgtagcacgcgcagatatgacggcattaaaggcattactgttactggcaaagtttgcccaacaaaaaataagtgcttcatcagcggtcaaagtactatccgttgctatcaaagtggctttggatttacggctcaatttacattccacctatgaggatctagaacttgatgaaatcattaaaagaagacgcttgtggtgttattgtttttcaacagacaaattcttttctgtggtgttgtcaagaccgccctttctcaaggaggaaaacactgatgtattaacagatgaaagctatgttgaactattcagagataaaattctgcccaatctttctataaaatacgatgattcaaaactagaaggggtgaaagatattgtatccgttgtaaacttactcgcgaatcaccttgaatatgtaccatacattcaatcatattttttgtcgagattatccctcatagagtctcaaatatattactcatgtttttccatcagaacaactttagacgatacactagatgaaatcattgaaaatgtactggaaaatcaaaaggcgttagatagaatgcgagacgatttgcccaccatattatcattagaaaattacaaggaaaacatgaggattttatctttggattcttcgaagttagattttgaagtgagttgttgtactactattctattacacctcagatggtaccatcaaaagataaccctgagtttatttgtcatatccatcattggagataacttagatcaacgggaaagttcccggcatgatatagctgaaattattagaaggtcaagattggatttcaagcgaaattgcatcgaagtacttaatattttgaaagattttgaatactaccctactgttcagaatgagtttctgtatttttctctcacaacggttttttccatgtttctgtatttgtcagagattatggttaatgacgaacatgccatggagactggttatataattggattattgagggatacacatacccgtatgcttggatctgaagaacgctgtctttcagtacacaatctgaagtggcaaacatctctttttttttacactttttttctacggagtacgatggaaaagttcaatctgacaagtaaatacgcaaaattctatgcctttgattcaaattattatgagggtgttctcaataggttagttaagcatacgagagaatcaaaagatgatatggtcgagctcttgaaaacttcgttcataaataaagagaagatggctgcatttggtagtttcgttacagaggaccaagaaaaaatggaagtgtccttcaatattttcaatgaaataacaatccaggatttgaacttcttgcaattttcaagcattccgaaattgtgggaaaataaaactcttgagccaggcgaggaatatcatcatagtaatggtaccaatactgataataacgagactactggcgctgatgatactgacgataataataataataataataataataataaaaatggcaataatagtagtagtactattaataataataacaataactacagtaacagtaacaataatgacaatgacaacaatattaatgatgatgatgatgatgatgatgatgatgatgatgatgatgatgatgatgatgatgatgatgacaatgatgatgattatagtaataatggtgctgatgatgatgaagaagacgatgactatgacagatctttatttccaacaggtttagcttcgctgcttgatgcgtcatatcctgaacgtacggcgaatgattatagagatgagaatgaacaatcgaataaattattcgaaaagattgaaggccatttggagcacggtgtttttttttacgatcgggatttcttcttcaagaatgtgtgtgtaaaaatg

SEQ ID NO: 216 - protein, 1094 aa, Saccharomyces cerevisiae
MNMDSGITSSHGSMDKTQKQSSEWAANQKHNQRVENTRVLMGPAVPAMPPVPSNFPPVPTGTIMSPQLSPFPDHRLRHHPLAHMMPADKNFLAYNMESFKSRVTKACDYCRKRKIRCTEIEPISGKCRNCIKYNKDCTFHFHEELKRRREEALNNKGNGKSVKKPRLDKENKFKDENFDIAVRSRNTSSTDSSPKLHTNLSQEYIGVSAGKSASDKEDTWPDFVPIDRTVLEKIELNHTKVAGKVFVLEEICKNMKGTIEKLAEKSKIDVIDKEYMKRPKRKQYSKALLTKQKMFHFRQNVLSHLTDEEFLSPINEMFTTTFKYSILQTKLVLDFSFRSASSPSSDNILYPLPRLAIAKRLLKNIKCPSLASLLHIVDVDQCLQFADVHFDPAKGRLTSSQAFLLNICLCLGATVTNFEEKQELVDEDNHETYYFEKFELWRLRSFTFLNSVYYYHKLSVARADMTALKALLLLAKFAQQKISASSAVKVLSVAIKVALDLRLNLHSTYEDLELDEIIKRRRLWCYCFSTDKFFSVVLSRPPFLKEENTDVLTDESYVELFRDKILPNLSIKYDDSKLEGVKDIVSVVNLLANHLEYVPYIQSYFLSRLSLIESQIYYSCFSIRTTLDDTLDEIIENVLENQKALDRMRDDLPTILSLENYKENMRILSLDSSKLDFEVSCCTTILLHLRWYHQKITLSLFVISIIGDNLDQRESSRHDIAEIIRRSRLDFKRNCIEVLNILKDFEYYPTVQNEFLYFSLTTVFSMFLYLSEIMVNDEHAMETGYIIGLLRDTHTRMLGSEERCLSVHNLKWQTSLFFYTFFLRSTMEKFNLTSKYAKFYAFDSNYYEGVLNRLVKHTRESKDDMVELLKTSFINKEKMAAFGSFVTEDQEKMEVSFNIFNEITIQDLNFLQFSSIPKLWENKTLEPGEEYHHSNGTNTDNNETTGADDTDDNNNNNNNNNKNGNNSSSTINNNNNNYSNSNNNDNDNNINDDDDDDDDDDDDDDDDDDDDDNDDDYSNNGADDDEEDDDYDRSLFPTGLASLLDASYPERTANDYRDENEQSNKLFEKIEGHLEHGVFFYDRDFFFKNVCVKM

SEQ ID NO: 217 - DNA, 2277 bp, Saccharomyces cerevisiae
atgacagcgccattgtggccaaacaagaatgaaaaaaaccacacagttaaaagagcgttatcaacggatatgaccagcaatattttgagtagcacaaacgcgagctcaaacgaagaaaattctaggagttcttctgcagccaatgtacgctccggaacaggtgcaaatacacttactaatggcggcagtactagaaagagacttgcgtgcactaattgtagaaatagaaggaaaaaatgtgatttaggatttccctgtggtaactgttccaggttggaattggtttgtaatgttaatgacgaggacttaagaaagaagcggtacactaataaatatgtcaagtctttggagagccatattgctcaactggagaccaacttaaaaaacctagttcagaagatctaccctgacgatgagcaaatactgaaccgaatgatggtaggtgatgtattatcagctctaccagacagttcacaagtctcaatcaattatactgaccaaactccctctcttccaattcccgcaaccagaggtacattcattattgaaaacgataaggtcagtcaacctctatcgtcctttaaccaacaaacagagccatctactctaaactcgggtatcttcaacacccaaaaacaaaatttcgaagaatcccttgatgatcagttacttttacgaagatcgttaacaccgcaaggtgaaaaaaagaagaaaccgttggtaaaaggtagtctttatcctgaaggacctgtcagttacaaacggaagcaccccgtaaaatcggacagtttattgcctgtgtcttcgttaacagctgctacagacccatctactttttctgacggtataactgctggtaattccgtcctagttaatggtgaactgaaaaaacgtatatccgacttgaagaccaccgtaatagtaagaggactaaacgatgataatcccaactctatcaataacgatcccaggattttaaaatctctttccaatttctataagtggctgtatccaggttattttatttttgttcacagagaaagttttctttatggattcttcaatcactccaagaataactatgaagactcaagttactgttctgtcgaattgatatatgccatgtgcgctgtcggttcgaggcttacaccggatctacaagaatattcagaagtgtattatcaacgaagtaagaagactttattacagctcgtctttgatgagcaaagtacagcccgtatcaccaccgtccaagcgctattttgcttagccttttacgaactggggaagggtaataatcaattagggtggtacttctcgggcctggctatcagggtcggctacgacatgggatttcaactggaccctaaagtctggtacgttgatgataacaatctgcagctgacccaaagtgagttggaaataagatcaaggatttactggggttgctatatagcggatcattttatttgcctgatgttgggtagaacgtccacattaagcgttagtaactcaaccatgccagagtcggatgagctgccagaagtcaacggcaccgaagagttcagatttattggaagacatgttttacagatatccttgcctctgaaaaacttgataattctatcaaggcttgtacaaatcttcacctctaaaattttcatcgagtcggaagatatagcacgaaaactaaagtacttgaacactttcaattctcaggtttacaactggagacaatctctaccggaatttttgcaatggtcgaaaacactcatcgagaacgatgacgtatccacagaccccactatatcttacttctggtattgctactacatagtgcggctcacctttaacaagccatttatagaagactctcaagaatccgaaacggtagtcatagagatcatcgatgatttgaagactttgctggacaatttcgggaaaaaattcggaaactacacgaagggaaacctttaccaactttactcatgcctgttggccatcaactgtttgaagaagttgaaagagatacgttccagtgagcaagactcatggaatgcacaattggattttttcaatcacatcttctacacacaactatatcccgcatatgatctgccgaaaaagctgcaggaggatacggagctggaaacagaacaagaaaaccagatgttgaaccaagttggaaatataaactacacgcacgatttttcactctcccacgaaattgacgatcttatcagagaactgtttggggtgggcacacctcaaaaactc

SEQ ID NO: 218 - protein, 759 aa, Saccharomyces cerevisiae
MTAPLWPNKNEKNHTVKRALSTDMTSNILSSTNASSNEENSRSSSAANVRSGTGANTLTNGGSTRKRLACTNCRNRRKKCDLGFPCGNCSRLELVCNVNDEDLRKKRYTNKYVKSLESHIAQLETNLKNLVQKIYPDDEQILNRMMVGDVLSALPDSSQVSINYTDQTPSLPIPATRGTFIIENDKVSQPLSSFNQQTEPSTLNSGIFNTQKQNFEESLDDQLLLRRSLTPQGEKKKKPLVKGSLYPEGPVSYKRKHPVKSDSLLPVSSLTAATDPSTFSDGITAGNSVLVNGELKKRISDLKTTVIVRGLNDDNPNSINNDPRILKSLSNFYKWLYPGYFIFVHRESFLYGFFNHSKNNYEDSSYCSVELIYAMCAVGSRLTPDLQEYSEVYYQRSKKTLLQLVFDEQSTARITTVQALFCLAFYELGKGNNQLGWYFSGLAIRVGYDMGFQLDPKVWYVDDNNLQLTQSELEIRSRIYWGCYIADHFICLMLGRTSTLSVSNSTMPESDELPEVNGTEEFRFIGRHVLQISLPLKNLIILSRLVQIFTSKIFIESEDIARKLKYLNTFNSQVYNWRQSLPEFLQWSKTLIENDDVSTDPTISYFWYCYYIVRLTFNKPFIEDSQESETVVIEIIDDLKTLLDNFGKKFGNYTKGNLYQLYSCLLAINCLKKLKEIRSSEQDSWNAQLDFFNHIFYTQLYPAYDLPKKLQEDTELETEQENQMLNQVGNINYTHDFSLSHEIDDLIRELFGVGTPQKL

SEQ ID NO: 219 - DNA, 1350 bp, Saccharomyces cerevisiae
atggtcaatagtaagaggcagcagagaagcaagaaagtagcgtcatcctccaaagtgccccccaccaaggggaggacatttactgggtgctgggcatgcagattcaagaaacgcagatgcgacgagaatagaccaatctgttcactgtgtgccaaacatggagataattgtagttacgatatcagacttatgtggttagaggagaacatctacaaagtacgcaagcattcactgatcagttcattacaggctcgcaaatcgaaatcgaaaccattgtgccagaaaatctcaaaatcaaggtttaaacaaatgacccattttagacaactatcacccccgacaagtgactgcgaagacagcgtgcacgaggcaagtaaggaaactacgcttcctaacgataatacattcaccataagcgtacggagattgaagatatacaataacgctgtggcctctgtctttggtagcatgacaaatagagattatactcaaaagcgcatagacaagaagttggacgaattgcttaatatggtggaaaacgacatatctgtggtcaacctcaattgctccaaacacgggccttactcagttttcagggccaatccggctgcagttacctctgctcttacagatcagctgccgtcgccgggtcattcgatgtcgtcagcagaggaaaccactactgcagcgctgtcatcgccgccagaagacagcacctctttgatcgatattatccaaggcaaaattttcgggatcctatggtttaattgctacgggaacatgatattgaaccgacaagaatacacgacgtggttcatcaataagatgaggaactcgttgaccacggaattcatacgcttccttgggaaaataattgacgacccggacatcaatatggcctcgtgcctgttcaaagagtgcatcgctcgttggagttgtgtcgattggcaatccatagctataacaatgctggtcatcattcatggatatacctgccccaacttgacaaagcttctaagagtgtggtttctccagcaaaagctattgagattttcgatgtatccgctggtcaactttatcataaacaatacacaagatttagacgtcctgtaccattgtaatggattgctagggaatgccgacttattcgaggatccctaccaggacgagcttacgtcggagttacatgtcttggtcacggagcgcctagtgaatagttggaaagatacaatattgcaacaactttgctcatgtcaagataccacactttcatgttcccaactgcggtactggcagctacaactgaagtgtaatcaacaattttacaaggatgtatatgccatgcaggac

SEQ ID NO: 220 - protein, 450 aa, Saccharomyces cerevisiae
MVNSKRQQRSKKVASSSKVPPTKGRTFTGCWACRFKKRRCDENRPICSLCAKHGDNCSYDIRLMWLEENIYKVRKHSLISSLQARKSKSKPLCQKISKSRFKQMTHFRQLSPPTSDCEDSVHEASKETTLPNDNTFTISVRRLKIYNNAVASVFGSMTNRDYTQKRIDKKLDELLNMVENDISVVNLNCSKHGPYSVFRANPAAVTSALTDQLPSPGHSMSSAEETTTAALSSPPEDSTSLIDIIQGKIFGILWFNCYGNMILNRQEYTTWFINKMRNSLTTEFIRFLGKIIDDPDINMASCLFKECIARWSCVDWQSIAITMLVIIHGYTCPNLTKLLRVWFLQQKLLRFSMYPLVNFIINNTQDLDVLYHCNGLLGNADLFEDPYQDELTSELHVLVTERLVNSWKDTILQQLCSCQDTTLSCSQLRYWQLQLKCNQQFYKDVYAMQD

SEQ ID NO: 221 - DNA, 3180 bp, Aspergillus nidulans
atgctgaatcccagtacctcagatatccacacctcgcccacggccgttggaaatggaagaaaacgaccacaccctatagccgattcgggttctgctatgccttcagatccatcggcgcaacaactaccgcatccagccaatgaaagtgccgctatcccgtcgatagcgagttcgtcctctttccgaaacgtctccgcttgcaatcgatgtaggcagaggaaaaacagatgtgaccaacgactgccacgatgccaagcctgcgagaaggcaggggtccgttgcgtcggttacgatccgataacaaaacgtgaaattccccgcagctatgtctacttccttgagtcgagggtcgcgtacctcgagaaggtactgatggataacgggattgagtataatgaagctgtggcattcgatgaggaggaagctgtcaaaatcgaagcggggtatgaagcatatgcgggctcagcaaacggaccagctgccggcgaaatagccgcgcaggatgggagtaatgacaagtccgtgcggatcaagaaggaaaagaatgggcctcttgggctggaaaaggcttcgcgatatgaccatgacccggaggtgaagcaagactccgacgcagaagatggctggcggatacagaacctcgtttcgaatattgggatggtttcggtccaaggaacctcggatccgcggtatctgggttcaacgtctggaatttctttcgcccgggttgtatttgctgcggtaaagagttcagtgcctggaaactcatcggaacgtggtccatcgcgcccgaaggaacgtctaccgcatagcgccacgggaacggaagggagcaccacgcgggactcgtttttcgggctgcagacacggccgatgatgaagtgtgcagcattcccggacagggaactggccgagcggctggccgatctctatttcgaacatgcgaatccgcagatacccattgtacatcgtgttgactttatggaattgctcgaccgtacgtattccgttgacgagaaaagccgctcccctcgcagtctgtattttctcaatatcgtatttgccattggatctggaatcatatttgaagacaaaccagcagaagatcagaaagaaggtcgtgatcattccccctctgcaaccaagagacagcgcctctcaagtcgtcagtatcagccagaagaatatcatgcctctgccattgtccacttagagtctttcttgtcgacttctccaaccactgatggttttggtgctttggaggagcttcaggcagtcctcctccttgcaagttttgctctgctccgtcccgtggcgcctggcctctggtacattgtcggggttcgaatgcgtcttgcagttgaccttggccttcattatgaagatggagcaggcattgatggacctgaaaatgacaatatgaatgctacgaataacaaggacggcgaaaaggcgaagctacgcatcgacgaccacgagcgaggtcgcgcagaatgggtgcgtgactttcgtcggcgattgtggtggtgctgctacagttttgatcgtctggtcagctgctgtgtcggtcgtccgttcggcatcagtgatcaggccataagtacagaattcccatccatcctggaagacaaatatatcactaaatctgggataatcaaagccccggaaggcgctcccagttataaacattctgcctttcattattttaagctgcgcgtgctgcagtcggagattcaggacgttctgcagcaccagcaggcccgattcgcccgacaacgaggcccacccggcgccaggagctttatgcgccttgatgtcgtgtcacccttccttcaaggttttgactctttccgatcgtggcggagggacgttgatcggcggttgttggaatggaagaatagtgcgccgatgccttcggaaaatggtgtgaggtttccacttgagttcctggagttgaactactggcaagcagtcatcatgctctatcagcaaagcctcaccgttcccgctgagttggctgatgagctttcccctgctgaggatgtttccagtccgtccttttctcaggtagaagaggacgaacatgatatctattacaaggttgctgaagctgggcaaaaagtcatacggatataccgtcagatgcatcgtgtgcgattggttaattatacctatctagctactcatcatattttcatggctggaatttcattcctgtatgctatctggcactcgccatatgtgcggagtcgtctgacacttgatgaagtggacttcacggtcctagcagcgacgtcagtgcttagggacctcatgcacaagtgcccacccgcagaagcttgtcgtgacgcattcgaacggatgagcaaggccaccgtcgaaatgagtctttctacaactggctttgggccacaggttgaactgaaccgggtgcagaccagcactagcgggtcaagacagtttaatgcaacgcaatccagatcaaggccatattcgcgacagcaagcagagcaacggcagcgacagagcgcatctcggcgacaattacaaatgagacagtctcggcctctaccaagattcgatatgaacctcgaagatctctttggcgacaaccgcgcagtcgctgagaggcaaggtagtggtggcatgggaaagctagcccaaccctaccctgtctctgagacttcggatcctaattttgcgcggccacaatcccatcgcaatccgtctatggaatattacggccctttcgagaaccccgtctcgccacagcagccccaaccacaaccgcgatactactacaacaattccccccagcagagcggatcacccggcagcgtcgttgcggccagcggtatcccaccataccaagtaacacctacagagcaggaaaacccctcgggcatgggtctcgattatctggattacgatccaacaggtatcgagcgccacgtgtccctgggatctgaagagaactcggactttaaatttcaaggcggcgcacagtcactgggccatggtgctggccataatttcgggatcgatctaggtttcggcatggccgttgattttcaacatgattggagtgaaaatgccaattatgatctacttgaggggtatttcttcggtggagcaggcgcaactggaccgggacatgggcatgggcatggctcgggtata

SEQ ID NO: 222 - protein, 1060 aa, Aspergillus nidulans
MLNPSTSDIHTSPTAVGNGRKRPHPIADSGSAMPSDPSAQQLPHPANESAAIPSIASSSSFRNVSACNRCRQRKNRCDQRLPRCQACEKAGVRCVGYDPITKREIPRSYVYFLESRVAYLEKVLMDNGIEYNEAVAFDEEEAVKIEAGYEAYAGSANGPAAGEIAAQDGSNDKSVRIKKEKNGPLGLEKASRYDHDPEVKQDSDAEDGWRIQNLVSNIGMVSVQGTSDPRYLGSTSGISFARVVFAAVKSSVPGNSSERGPSRPKERLPHSATGTEGSTTRDSFFGLQTRPMMKCAAFPDRELAERLADLYFEHANPQIPIVHRVDFMELLDRTYSVDEKSRSPRSLYFLNIVFAIGSGIIFEDKPAEDQKEGRDHSPSATKRQRLSSRQYQPEEYHASAIVHLESFLSTSPTTDGFGALEELQAVLLLASFALLRPVAPGLWYIVGVRMRLAVDLGLHYEDGAGIDGPENDNMNATNNKDGEKAKLRIDDHERGRAEWVRDFRRRLWWCCYSFDRLVSCCVGRPFGISDQAISTEFPSILEDKYITKSGIIKAPEGAPSYKHSAFHYFKLRVLQSEIQDVLQHQQARFARQRGPPGARSFMRLDVVSPFLQGFDSFRSWRRDVDRRLLEWKNSAPMPSENGVRFPLEFLELNYWQAVIMLYQQSLTVPAELADELSPAEDVSSPSFSQVEEDEHDIYYKVAEAGQKVIRIYRQMHRVRLVNYTYLATHHIFMAGISFLYAIWHSPYVRSRLTLDEVDFTVLAATSVLRDLMHKCPPAEACRDAFERMSKATVEMSLSTTGFGPQVELNRVQTSTSGSRQFNATQSRSRPYSRQQAEQRQRQSASRRQLQMRQSRPLPRFDMNLEDLFGDNRAVAERQGSGGMGKLAQPYPVSETSDPNFARPQSHRNPSMEYYGPFENPVSPQQPQPQPRYYYNNSPQQSGSPGSVVAASGIPPYQVTPTEQENPSGMGLDYLDYDPTGIERHVSLGSEENSDFKFQGGAQSLGHGAGHNFGIDLGFGMAVDFQHDWSENANYDLLEGYFFGGAGATGPGHGHGHGSGI

SEQ ID NO: 223 - DNA, 1584 bp, Saccharomyces cerevisiae
atgaattatggcgtggagaagctgaaattgaaatattcgaagcatgggtgtattacttgcaagatcagaaagaagagatgctctgaagataaacctgtgtgccgggactgtcgtcgattaagttttccctgtatctatatatcagaatctgttgataagcagtctttgaaaaaaataaaggcagatatacagcaccagttgatcagcaagaaaagaaagcatgctcctgacagtgctcagaaagcggccgtggccacccgtactcgacgggtcggtagcgacgaacaggataaccaggtatatttgtcaaaaccgctggaagattgcatttctcagaagctggactctatgggattgcagctgtacaactactacaggtctcaccttgcaaacataatttccatcgcgcccatgaaccagaactactatctgaacattttcttgccaatggcccacgagaatgatggtatattgtttgctattcttgcttggtcagctaatcatttgtctatatcatcatcaaatgagctgcgaaaggatgaaatatttgtcaacttggcgaacaagtatacatacatgtcgttatcgcatctaaagacaaacgagggctcaagtgcctgtgctaaactggggtttctatattcactagcacaaatcctaatcttatgtggttcagagatatgtcagggtgatgtgaaattttggaagatattattgaatataggaaaaaatttgatcgaaaaccatgtgggcaaggatgtctcacggatactaaccactactacagaagaaccctccctagaggagaggataatcttccccaatttcaattccgttgttaagtactggctgattgtgaattttatatatcatgatattttgaatttcaatacaacgtccttcccgatcgaacaatacgagaaattcttccaaagggatcagaactctttacccagctcagccaactttattgagtcaatagactcgccaattgaggaaatagaccctttaattggcatcaacaagcctattttactactattgggacaagtcacaaatttgacgaggtttttgcagactatggaacaggaagaaatgctagagcatggcgataaaattttgagtttgcaagtcgagatttataaattacaaccttcgcttatggcgctggaacatttggatgatgaaaagaaattttactatttagaactattcgagataatgaaaatttctaccttaatgttctttcaattaactttattaaagattgacaaagattcgctggaactacagatactgagaaacaaattggactcgaagctagacaaggtcatcggaacttttttggaaggatcgttatgcttcccacttttcatttacggtgtatgcattcaggtagaagatatggagaaaaaaatagatttggaagccaaatttgacgacattttaaaacgatataaatgttacaatttccaaaatgctagattattgatacggaaaatttggcaaaacgaggctgatggcatcagtgagcatgacctggtccacatgattgacgaattagattacaatattaattttgcc

SEQ ID NO: 224 - protein, 528 aa, Saccharomyces cerevisiae
MNYGVEKLKLKYSKHGCITCKIRKKRCSEDKPVCRDCRRLSFPCIYISESVDKQSLKKIKADIQHQLISKKRKHAPDSAQKAAVATRTRRVGSDEQDNQVYLSKPLEDCISQKLDSMGLQLYNYYRSHLANIISIAPMNQNYYLNIFLPMAHENDGILFAILAWSANHLSISSSNELRKDEIFVNLANKYTYMSLSHLKTNEGSSACAKLGFLYSLAQILILCGSEICQGDVKFWKILLNIGKNLIENHVGKDVSRILTTTTEEPSLEERIIFPNFNSVVKYWLIVNFIYHDILNFNTTSFPIEQYEKFFQRDQNSLPSSANFIESIDSPIEEIDPLIGINKPILLLLGQVTNLTRFLQTMEQEEMLEHGDKILSLQVEIYKLQPSLMALEHLDDEKKFYYLELFEIMKISTLMFFQLTLLKIDKDSLELQILRNKLDSKLDKVIGTFLEGSLCFPLFIYGVCIQVEDMEKKIDLEAKFDDILKRYKCYNFQNARLLIRKIWQNEADGISEHDLVHMIDELDYNINFA

SEQ ID NO: 225 - DNA, 2625 bp, Aspergillus niger
atgtcgcatacgaaggatcaaccaccctttgataatgagaagaaccagagcactggctcgggttttagggacgctctgcaaagagatcccctcgtggaggctcgctctgccgtccgcaaaacctcgtcttcagctccggttcgccgccgaatcagccgtgcgtgtgaccagtgtaaccaactccgaacgaaatgcgacgggcagcatccgtgcgctcattgcattgaattcggactgacctgcgagtatgcgcgagaacgcaagaagcgtggaaaagcgtcgaagaaggatctggcggcggcagctgcggcggctacccaagggtcgaatggtcattccgggcaggccaacgcgtcgctaatgggcgagcgaacgtcggaagacagccggccaggacaagacgtgaacggcacatacgactcggcttttgagagccaccatcttagctcgcagccatcgcatatgcagcatgcaagcactgcagggatatccggcctgcacgagtctcagacggcaccgtcgcattcgcaatcatcgctaggaacgactatcgatgcgatgcatttgaatcatttcaacacgatgaacgattccggtcgcccggcaatgtccatatccgatctgcgttcgctacccccgtccgtcttaccaccgcaaggactaagctccgggtacaacgcgagcgccttcgctttggtgaacccgcaagagccgggctcaccagctaaccagtttcgcttgggaagctcagcggaaaacccaaccgcaccgtttcttggtctctcgcctccaggacagtcgcctggatggctccctcttccctcgccatctcctgccaactttccttctttcagcttgcatccgttttccagcactttacgataccctgttttgcagccggtcctgcctcacatcgcctccattattccgcagtcgctagcgtgtgaccttctggatgtttacttcactagttcctcttcgtcccacctgtctcccttgtccccatacgtggtgggctacatcttccgcaagcagtctttccttcacccgacaaaaccccgaatatgcagccccggtctcctggcgagtatgctctgggtagccgcacaaacgagtgaagctgcgtttctgacatcgccgccctcggctcgggggcgtgtatgccagaaactgctagaactgaccattggtttgctccgaccgttggtccatggtcctgctaccggagaagcgtcgcccaactatgcggcgaatatggtcatcaatggcgtcgctctgggcggatttggggtctccatggatcagctgggcgcgcaaagtagcgccaccggcgccgtggatgatgtagcaacttatgtgcatcttgcgacagtagtatccgccagcgagtacaaggcggccagcatgcgctggtggactgcggcgtggtctctagcgcgtgagctgaagctaggccgtgagctgccacccaatgtttcccacgcacggcaagatggagagcgagatggggatggcgaggcggacaaacgacatcctccgaccctcatcacgtcactgggtcatggatcgggaagctccggcattaatgtcaccgaagaggagcgtgaggagcgtcgacgcctatggtggctcttatatgcgaccgatcggcacctggcgctgtgctacaaccggcccctcacgctgctggacaaggaatgtggcgggctgctgcagccgatgaacgatgatctgtggcaggtcggcgactttgcagcggctgcctaccgccaggtcggaccgcccgtcgagtgtacgggtcacagcatgtatggatactttctaccgctgatgacgattcttggagggatcgtcgatctgcaccacgctgagaatcatccgcgctttggcctggcgttccgcaatagcccggagtgggagcgtcaggtactggacgttacgcggcagctggacacatatgggcgcagcttgaaggaattcgaggcccgctacaccagcaacttgactctgggggctacggataacgagcctgtcgtcgaaggtgcccacttggatcacacgagtccttcggggcgctccagcagcaccgtgggatcgcgggtgagcgagtccatcgtccacacgaggatggtggtcgcctacgggacgcatatcatgcacgtcctgcatattttgctcgcgggaaaatgggacccggtgaatctgttggaagatcatgatctgtggatctcctcggagtcgtttgtctcggccatgagccatgcggtcggtgccgcagaagcagcggcagaaatcttggagtacgacccggatctcagcttcatgccgttcttcttcgggatttacctactacagggcagtttcttgctgctactggcggcggacaagttgcagggcgatgccagtcccagtgtcgtgcgggcatgcgagacgatcgtgcgggcgcatgaagcgtgcgtcgtgaccttgaacacggagtaccagaggacattccgcaaggtcatgcgatcggcgctggcacaggttcgaggacgcatcccagaggactttggggagcagcagcagcgccgacgcgaagtgcttgcgctataccgctggagcggcgatggcagtgggctggcactg

SEQ ID NO: 226 - protein, 875 aa, Aspergillus niger
MSHTKDQPPFDNEKNQSTGSGFRDALQRDPLVEARSAVRKTSSSAPVRRRISRACDQCNQLRTKCDGQHPCAHCIEFGLTCEYARERKKRGKASKKDLAAAAAAATQGSNGHSGQANASLMGERTSEDSRPGQDVNGTYDSAFESHHLSSQPSHMQHASTAGISGLHESQTAPSHSQSSLGTTIDAMHLNHFNTMNDSGRPAMSISDLRSLPPSVLPPQGLSSGYNASAFALVNPQEPGSPANQFRLGSSAENPTAPFLGLSPPGQSPGWLPLPSPSPANFPSFSLHPFSSTLRYPVLQPVLPHIASIIPQSLACDLLDVYFTSSSSSHLSPLSPYVVGYIFRKQSFLHPTKPRICSPGLLASMLWVAAQTSEAAFLTSPPSARGRVCQKLLELTIGLLRPLVHGPATGEASPNYAANMVINGVALGGFGVSMDQLGAQSSATGAVDDVATYVHLATVVSASEYKAASMRWWTAAWSLARELKLGRELPPNVSHARQDGERDGDGEADKRHPPTLITSLGHGSGSSGINVTEEEREERRRLWWLLYATDRHLALCYNRPLTLLDKECGGLLQPMNDDLWQVGDFAAAAYRQVGPPVECTGHSMYGYFLPLMTILGGIVDLHHAENHPRFGLAFRNSPEWERQVLDVTRQLDTYGRSLKEFEARYTSNLTLGATDNEPVVEGAHLDHTSPSGRSSSTVGSRVSESIVHTRMVVAYGTHIMHVLHILLAGKWDPVNLLEDHDLWISSESFVSAMSHAVGAAEAAAEILEYDPDLSFMPFFFGIYLLQGSFLLLLAADKLQGDASPSVVRACETIVRAHEACVVTLNTEYQRTFRKVMRSALAQVRGRIPEDFGEQQQRRREVLALYRWSGDGSGLAL

SEQ ID NO: 227 - DNA, 2346 bp, Schizosaccharomyces pombe
atgtccgcgtctggcaaaaaaccggggacaaaaggaacgaaaaggcatcgaaagatcacttcttgtagagaatgccatcgattaaaactaaagtgtgatcgcgtttggccctgtgagaactgtaaaaagagagggatccctaatctatgtcccaatggaatccttgtttccgttagtgacaaattaattaaacttcttttatcaaggattgatactttgcagaattgtgttaaatctgtttctccaaatcatgaatccttaatcgtttcctctgatgatcaaaaaataattgatgatatctacgagaagtttggcgaaaagcccgctgaagataccaaggatgaaaatagaagtcaaccaatccacgatcctgatcatcctacgttggaggatgtggcccagatgttaggtaagctaaaggtgggctctcatggctacttcaattattatggtgcctcttcaagtcgctcttgcatacctcagcaggaccctaattccgaggaggaggacaccttcatgcagagaccttttttgtatcccgcgtcatcctataactcggccttgcactggagccatagaataccaaatatactcaatccctccactttatgtgacatgcttcctgttcctcagttcgccgtgcgcttgatgggcttgtactttgataatgtcggatggagcagtcatattatccaccgtccttcatttgaagaagcttgtcttaatttatattctgcggcccccgatcgtacaaatcctcagccgcaatttttgtctttaacttatatggtgttttgcttgggaacattattcacatcccccgtattggttcgcaatcgatattccctcgcgcatgaatttttccttcgtgcccagctttgttttgacatatcagtttccgggtttacgccatctttggattcggttgtcgccgttatgcttatggctcaatattcgtatttttgcgatcgtcttgaacgcacaaactttgcctggaattgtattggtctcgctattcgtttggcggttgccatgggtttacatagggatggtgaagtattcgaactgagtgcttttcagttacatatgcgaaggcttatttggtctgagctcttattttttgatcgcatgctttctatgagtctcggtagaccttttgccatcagcaatgaccagaccaatgtccatgaaccctccaatgtttgtgacatacaaatcagctctcaaagcaactgtattccagacccctcttatgagcgtaccgaagcgagctttaccatttttaaagcgaaactttcaaaagttattgccagtgtcttagatcgtgccttccgattcactccccctagctattctgaagttgaagctcttaccgaacagttcaaagttttagaaaatgaacttccagattatatgcgaatttcccgggacacccccaacttaccacctatggtcatcattgaacaatattcggctaaatttttaattcaacaagctcttctataccttcaccgtccctggtttgtcagggctgctactcgcaaagaagaacgtgaacattacaagtcatcttttaatctttgtacttcggtttcccatgaattaattcacaatctttattcgttgatgtgtcttgtaccagtagagcctttgaggtggtgggtatttcggtttcattctttgaatgccggaatcattcaagctgcatacgctttgtgttttcctaataccgattatgcattaacagcttataatgatttgcaatacatatgccgtatatttgagcatttgaaaggcggttttatgttcagtaataaggattatgattttttgatacaattgaaatccaaagttttcaaccgatttcagctttccagtcaaggtcttacgcctgaagatttaacggaggatgtcccatttttgcatttcaatgttccttcttcaagaccaaatagtaaatctcccgatgattctagtatgagggcggagaaagctgcgcagttggacggacttgggctgtcttcggatgatttaaatacggctcaatcagaaaatttacccatttatgaacaagaaaatccacttctatttgattcactatcgtggcatgtcccaaaagacgatacacggaatgataagtcaccacttgttccaacgtggaatgctgatatgatgttcgaagaagaacaaaagcccattgttcctattgatttgtcttctatgcaggatgatcaggtttcatcattgaccacaaatgaagaatttgatcctttgagttctttccaggcttctcattctggatctaatttttggacaaatatgatgaacgaaatgggtattccgaag

SEQ ID NO: 228 - protein, 782 aa, Schizosaccharomyces pombe
MSASGKKPGTKGTKRHRKITSCRECHRLKLKCDRVWPCENCKKRGIPNLCPNGILVSVSDKLIKLLLSRIDTLQNCVKSVSPNHESLIVSSDDQKIIDDIYEKFGEKPAEDTKDENRSQPIHDPDHPTLEDVAQMLGKLKVGSHGYFNYYGASSSRSCIPQQDPNSEEEDTFMQRPFLYPASSYNSALHWSHRIPNILNPSTLCDMLPVPQFAVRLMGLYFDNVGWSSHIIHRPSFEEACLNLYSAAPDRTNPQPQFLSLTYMVFCLGTLFTSPVLVRNRYSLAHEFFLRAQLCFDISVSGFTPSLDSVVAVMLMAQYSYFCDRLERTNFAWNCIGLAIRLAVAMGLHRDGEVFELSAFQLHMRRLIWSELLFFDRMLSMSLGRPFAISNDQTNVHEPSNVCDIQISSQSNCIPDPSYERTEASFTIFKAKLSKVIASVLDRAFRFTPPSYSEVEALTEQFKVLENELPDYMRISRDTPNLPPMVIIEQYSAKFLIQQALLYLHRPWFVRAATRKEEREHYKSSFNLCTSVSHELIHNLYSLMCLVPVEPLRWWVFRFHSLNAGIIQAAYALCFPNTDYALTAYNDLQYICRIFEHLKGGFMFSNKDYDFLIQLKSKVFNRFQLSSQGLTPEDLTEDVPFLHFNVPSSRPNSKSPDDSSMRAEKAAQLDGLGLSSDDLNTAQSENLPIYEQENPLLFDSLSWHVPKDDTRNDKSPLVPTWNADMMFEEEQKPIVPIDLSSMQDDQVSSLTTNEEFDPLSSFQASHSGSNFWTNMMNEMGIPK

SEQ ID NO: 229 - DNA, 1911 bp, Schizosaccharomyces pombe
atgtctcaaaataaagcatgtgatctttgcaggttgaagaagattaaatgtagtcgagggcaaccaagatgtcagacttgtactctttttcaagcggactgtcattattctaatcgtgctcgccgtaagagacttgttcaaagaagcaaggagacgtttgggggaattacgttacccgtgtttgattatgccgctggtattaacggcaatgagccagaaccgagtgatcactcaattccaaatcaagaaaattttgcattaactactaatggaactattagtaaaaacattgaaaaacccgaggatggtgaagaatccgttcagagacgccttaaattgcttgaagaaaaaatcgatttgttgttagatatagctactgaaacttcagaatttaaacgtgaaaataaggctattgaattaccttccttggttacacaaattaaagatgcagaatcgattgttattaaacacagacaaggtagccctgtcgacaatacacctactcggatactgaatgtggaaagcttgttccctccacagttgccggactgggagaaggcattccatgacattcccaagaaggaagtagcccatgagttagtcacgtcttactttcagcatgtaaattggtggtggcctaccttcgtatataatgattttatgtatgagttcgaacgtctttatgcgttcgggttccatagcaataatgcttggctaatttctttttattctattttagcattaagcagcattaggaaaagacttggtaactcaaagacgcttgcagagtctttgttttcaacagcttgggtttttgttcaaaagtccgacttttttcttactccgagcattgacaaagttcaggctttaattgtcatgacacagtacgcagcttacctgtctagctcttctttatgtcggactttgtgcggccaagcctgcctcatggcccaacaattaaacttacatagaaagcaatccactgatgtggagcctgaaaaggctgaatcgtggaaaaggatattttggatgtgttatattctcgataaaaatatttctttgatttttggaaccccttccgtttttaacgacaaggatattgattgtaatttgcctgatagcaaatatgagcttttgtttggtgtacaatctggtggtgatttgatatttgttcctaccgtatcgttgacaataattcagagtgaaatacgaaatcgactatacagcgtgaagtcacctacgcaaatggcagcgagagaaaaaatcatcataccaatacatcaaaaattgaaagcgtgggaagaaaaccttccttctgaaataaaaatgtatcatgaaatgttgctaaacaacactttttctcccactatatcgcttagcgatcggttcgaatttttaactttcgcaggtatggaagtttacttttcttacttaaacactttaattatattacacagacctagctcgtcgacagagaatcgaaggatttgtattaatgcagcccgtgaagcagttcaattgttaaaaaatagactcaacattgatctcagggtcaatgttaaagcagatccgctatggatattcctatactgtccttttacaccttttttaataatatttaataaccttgttcacgaaactgatacggaaacggactcagaaacattacttaacgatttggatcttttacatgtaatttacgatttttttatggaaatggagccagttagtgacgtggctttggaacttgtcaaaattgcagacaaacttttgcgggttgctaaagaagtttgcagtgccaaaaataatgatgttacggattctacttttaaagatatcgttgaaggttttgaacttaacgacttaaacagttgggattttgacagagtaaccaatgttatgaggaatctt

SEQ ID NO: 230 - protein, 637 aa, Schizosaccharomyces pombe
MSQNKACDLCRLKKIKCSRGQPRCQTCTLFQADCHYSNRARRKRLVQRSKETFGGITLPVFDYAAGINGNEPEPSDHSIPNQENFALTTNGTISKNIEKPEDGEESVQRRLKLLEEKIDLLLDIATETSEFKRENKAIELPSLVTQIKDAESIVIKHRQGSPVDNTPTRILNVESLFPPQLPDWEKAFHDIPKKEVAHELVTSYFQHVNWWWPTFVYNDFMYEFERLYAFGFHSNNAWLISFYSILALSSIRKRLGNSKTLAESLFSTAWVFVQKSDFFLTPSIDKVQALIVMTQYAAYLSSSSLCRTLCGQACLMAQQLNLHRKQSTDVEPEKAESWKRIFWMCYILDKNISLIFGTPSVFNDKDIDCNLPDSKYELLFGVQSGGDLIFVPTVSLTIIQSEIRNRLYSVKSPTQMAAREKIIIPIHQKLKAWEENLPSEIKMYHEMLLNNTFSPTISLSDRFEFLTFAGMEVYFSYLNTLIILHRPSSSTENRRICINAAREAVQLLKNRLNIDLRVNVKADPLWIFLYCPFTPFLIIFNNLVHETDTETDSETLLNDLDLLHVIYDFFMEMEPVSDVALELVKIADKLLRVAKEVCSAKNNDVTDSTFKDIVEGFELNDLNSWDFDRVTNVMRNL

SEQ ID NO: 231 - DNA, 1071 bp, Schizosaccharomyces pombe
atgcgttcattatcttgtattgtgtgccgtcagaaaaagataaaatgtgaccgaaaaaatccgtgtaccaattgtgagcaggctggcgaaaaatgcatgtttaaagaatatgatagccgcaaaatacgacatccacatagctatgtgaaagccttagaaactaggttagcgggcttagaagctttttggaaaagggtgaaatatgctcctgtcaatgaaaaactcgaattgctaaaaacaatttcgtttaacgaccacttatctccagatatatcggtttctaaaactgataccacttttgaatttccagtctctttagacattagaggcccaaataccatcgccttttacgggccaacaaatgtctacgggccaccgttaactccaagctcgcctgagacgccttctttcccccctcaaaaccccagcttttctcctcttataactgattgtctaaagcttttttttaaatggcagtacccgcagtttttatttatcaaccgggaggcatttctggttgactattactatcgctatcatgaaggaagatattgttctgaacacttgctatatgcaatgtgtgcaattggtagtagaatgtccgttgatcctaacattgccgcattggccaagaatttttatcaaattgcttggaataaaataatagaatatggtctgggaaagtctcatattacttcaatccagtgcttgttgtgtttaggttatttcaatattgggatgggcaatacatcgctaggatggatgttgtcggggatggcatttcgaatgggtcaagatttgggatttcaattaaatccccgaaattggtcggtaaatgatcatcccgttgtttcaccggcagatgctgctgttcgtagtaggatttattggggaagttatgttacagatatatttattagctttgtccttggtaggcctactacgctaaaaaaatctgacactagcatccccgattctgaaagcttacctgatttcgatggagtcaacgagtacagagtgaacaacgcccttcttctaaaagaatatctatgtatacaatcctctgtttac

SEQ ID NO: 232 - protein, 357 aa, Schizosaccharomyces pombe
MRSLSCIVCRQKKIKCDRKNPCTNCEQAGEKCMFKEYDSRKIRHPHSYVKALETRLAGLEAFWKRVKYAPVNEKLELLKTISFNDHLSPDISVSKTDTTFEFPVSLDIRGPNTIAFYGPTNVYGPPLTPSSPETPSFPPQNPSFSPLITDCLKLFFKWQYPQFLFINREAFLVDYYYRYHEGRYCSEHLLYAMCAIGSRMSVDPNIAALAKNFYQIAWNKIIEYGLGKSHITSIQCLLCLGYFNIGMGNTSLGWMLSGMAFRMGQDLGFQLNPRNWSVNDHPVVSPADAAVRSRIYWGSYVTDIFISFVLGRPTTLKKSDTSIPDSESLPDFDGVNEYRVNNALLLKEYLCIQSSVY

SEQ ID NO: 233 - DNA, 1932 bp, Schizosaccharomyces pombe
atgcgttcattatcttgtattgtgtgccgtcagaaaaagataaaatgtgaccgaaaaaatccgtgtaccaattgtgagcaggctggcgaaaaatgcatgtttaaagaatatgatagccgcaaaatacgacatccacatagctatgtgaaagccttagaaactaggttagcgggcttagaagctttttggaaaagggtgaaatatgctcctgtcaatgaaaaactcgaattgctaaaaacaatttcgtttaacgaccacttatctccagatatatcggtttctaaaactgataccacttttgaatttccagtctctttagacattagaggcccaaataccatcgccttttacgggccaacaaatgtctacgggccaccgttaactccaagctcgcctgagacgccttctttcccccctcaaaaccccagcttttctcctcttataactgattgtctaaagcttttttttaaatggcagtacccgcagtttttatttatcaaccgggaggcatttctggttgactattactatcgctatcatgaaggaagatattgttctgaacacttgctatatgcaatgtgtgcaattggtagtagaatgtccgttgatcctaacattgccgcattggccaagaatttttatcaaattgcttggaataaaataatagaatatggtctgggaaagtctcatattacttcaatccagtgcttgttgtgtttaggttatttcaatattgggatgggcaatacatcgctaggatggatgttgtcggggatggcatttcgaatgggtcaagatttgggatttcaattaaatccccgaaattggtcggtaaatgatcatcccgttgtttcaccggcagatgctgctgttcgtagtaggatttattggggaagttatgttacagatatatttattagctttgtccttggtaggcctactacgctaaaaaaatctgacactagcatccccgattctgaaagcttacctgatttcgatggagtcaacgagtacagagtgaacaacgcccttcttctaaaagaatatctatgtatacaatcctctgtttacctagtggatttgagtaatgtagctgatgctatattactaaacgtatttgcccctatttcaatgccttacggtgcagattacatgctacaaaatttggggaagtacaatttagagcttgccaaatggcatcttaagcttccgagtgaactccggtggaaaaaaagcgaattgagaaaatttggtcaaaatcctgatctttctgtcgtttgcttatattacaatttaattaaaatatgtctgaatagaccttttttgtctagtaaggaggttatttccaatgatatgacacctaaattaatatgtcaagattccattgaagatatagagttacttattaagtatcgaaatgatgcgtttggaattaattctgtgtcttttgttttggtatatgcagctattgtaagctgcagtgtacttcttatgttatggaacgacgaagatccaattcttaatcgccaggtgatagaaaccaagctaaacttcttcttgattgtgttggttaaggcatcaaaagtgtgggatttagccacgaaatctattcatcttataaagagtagtttattgtccaagggtgtcgcttttacagattccttttctttaaaatcaaattccgaaggtcttaatgtcaataactcgaattcaagcattgcacacgagtccgcgaatatcccggacattttggatccatctaccaaaacattcgaacttgatattacttctcaagggcttcaaacattgtacggaggtccgccaattttaatgacatcagcttcccacagtgaaatttggaaaaactcattattttcaatgttcaatcagcctaacgattcagaggatggaaataataggttgtacgaacaa

SEQ ID NO: 234 - protein, 644 aa, Schizosaccharomybes pombe
MRSLSCIVCRQKKIKCDRKNPCTNCEQAGEKCMFKEYDSRKIRHPHSYVKALETRLAGLEAFWKRVKYAPVNEKLELLKTISFNDHLSPDISVSKTDTTFEFPVSLDIRGPNTIAFYGPTNVYGPPLTPSSPETPSFPPQNPSFSPLITDCLKLFFKWQYPQFLFINREAFLVDYYYRYHEGRYCSEHLLYAMCAIGSRMSVDPNIAALAKNFYQIAWNKIIEYGLGKSHITSIQCLLCLGYFNIGMGNTSLGWMLSGMAFRMGQDLGFQLNPRNWSVNDHPVVSPADAAVRSRIYWGSYVTDIFISFVLGRPTTLKKSDTSIPDSESLPDFDGVNEYRVNNALLLKEYLCIQSSVYLVDLSNVADAILLNVFAPISMPYGADYMLQNLGKYNLELAKWHLKLPSELRWKKSELRKFGQNPDLSVVCLYYNLIKICLNRPFLSSKEVISNDMTPKLICQDSIEDIELLIKYRNDAFGINSVSFVLVYAAIVSCSVLLMLWNDEDPILNRQVIETKLNFFLIVLVKASKVWDLATKSIHLIKSSLLSKGVAFTDSFSLKSNSEGLNVNNSNSSIAHESANIPDILDPSTKTFELDITSQGLQTLYGGPPILMTSASHSEIWKNSLFSMFNQPNDSEDGNNRLYEQ

SEQ ID NO: 235 - DNA, 1689 bp, Schizosaccharomyces pombe
atgtcttcctctcctccagctttaaagaaatttcgaaaacgcagcccaaaatcatgtttaatttgtaggcgccgcaaggtcaaatgcgaccgtcagcagccttgctctcgatgtaaagaaaggaacgaggtttgcacttacgcagatgataccattgataaaatgaacgtcggaccacatcctagtcatagcgaaaatgcttctgattctgaaaccacactggaagtttctcccgatattaatccgaaaaaaaatgagaaatttgatttttatggatggagatcactctttgagttgattaaatatagaaaggatagcgacatgtgctcatctcgaccttcgttttcaattcaggcttacagtagctataaagataatgtggttgttgagagtttggcgaaccttttaccgccattttgcatatcacagaaaattgttaatttattttttaaaacactaaatgttgtctgtcctatttatgatcaagagacagtagaaaaaagcttaaacaacattgaatcaccagaatctttttcgtacgaagatgccttcactttattaccaattattgctgcaactatccagctgagcgatttgcctgatgttattctcaatttttataattcggcggggattactccattggaatccagccgtcttataaatttaaaacttaacgagatatccgagcaggaatataaacatttatgcttgcctgataaagaaataattcagatgctgcttttgcgagcgtatgcaacaaaatttcgcacaagaataagaggagtgaatactgacttatgtagaagcattcacgtatcaaccttagtaactcccctcttccaagttacggaaaaaataggaaaaaatacgtcagatttgtggtttgctctctgtgaaattgatggtttggaatgtgtattaaagtaccgtccgccattcattcaacacgacacttatggtcgtctcaagccgcttcgttgtttttttaatgacgatattagctacaattttcatctacttcttggaaggttacttgattgtggtgtttcaatctataaatctgttcattcactcaccgttagtaaattcattgataaactggagagttatgaatcacagctttcgcttattttggtagatatagaagcaaagttttatgacccttctaatgaagatattcaatttcgatacatatttttgaaaatggtgttctggactgcacgtgtgaatttgtatcaatgttttattaccctggattcagggattttagaagatgaagaaactattattggtaatttgggtgaaagttgtattcagtgcgtgaggctactcatatctcaaatcactatattagaaaaacgaggctggcttttggtagcgttgttggagattatccacgccctcatgttggctgcgttttgccgtgataaaggctttgaggtgccttctgacttaggtgacataacattatatgtacaagaaagaatggttgatatcgtaacatttgatgatggcatggctgtccgatttggatatgttttaagattcatcaacagtatgttacacccaaatgaaccgcctatgcaagatgcagaacctgaaaccacggaggatccctctaaattattcgctgacatttttgattttacttcaaattactttataccgtccgcccttcttgatcag

SEQ ID NO: 236 - protein, 563 aa, Schizosaccharomyces pombe
MSSSPPALKKFRKRSPKSCLICRRRKVKCDRQQPCSRCKERNEVCTYADDTIDKMNVGPHPSHSENASDSETTLEVSPDINPKKNEKFDFYGWRSLFELIKYRKDSDMCSSRPSFSIQAYSSYKDNVVVESLANLLPPFCISQKIVNLFFKTLNVVCPIYDQETVEKSLNNIESPESFSYEDAFTLLPIIAATIQLSDLPDVILNFYNSAGITPLESSRLINLKLNEISEQEYKHLCLPDKEIIQMLLLRAYATKFRTRIRGVNTDLCRSIHVSTLVTPLFQVTEKIGKNTSDLWFALCEIDGLECVLKYRPPFIQHDTYGRLKPLRCFFNDDISYNFHLLLGRLLDCGVSIYKSVHSLTVSKFIDKLESYESQLSLILVDIEAKFYDPSNEDIQFRYIFLKMVFWTARVNLYQCFITLDSGILEDEETIIGNLGESCIQCVRLLISQITILEKRGWLLVALLEIIHALMLAAFCRDKGFEVPSDLGDITLYVQERMVDIVTFDDGMAVRFGYVLRFINSMLHPNEPPMQDAEPETTEDPSKLFADIFDFTSNYFIPSALLDQ

SEQ ID NO: 237 - DNA, 2757 bp, Saccharomyces cerevisiae
atgtcacaccatgttcctaatttatatggtacacctattcgcgaccctcacgaacgcaaacgcaattcagcgtcaatgggcgaagtaaatcagtcagtttcttcgaggaattgtgaaagaggaagtgaaaagggcacgaagcaaaggaagaaagcctctcacgcttgtgaccaatgtagaaggaaaagaatcaagtgcaggtttgataaacataccggcgtatgtcaagggtgcttagaagtcggtgaaaagtgtcaatttattagagttccattgaaacgtggtcctgcaaaaaaaaggggcagtgtagtatccattgaaaaattcagctcggataatgatcctcttcaataccgaccaagaacacattcatacccaatgaactcgggaaataactacttaccatcactcgccaggaattcctcttttccttccataagcagtctatttgttccctcgataactgctcaatcgcaacaatttgtaaaggtgccgtacgatgacatcaagcgtaggagctctctggcaatattaggcagcgattcatcgatatctaccgaatttgggggaaactatcgcttagatgaaaacttaaatgtcaggcaagaggggaaggatattgtagcgaaaggaatgataacgcccgtggaggaaatgggcgcatgttcatctaacgttcgtcgtcagggttcacaatctcttccaattcaagaacagcgcgctagcccgtacattaacccttttatctctgggagatccaggctaagcagcctttcctatacaagtgaggctacaacttcagaaggtaatacgcaaggtaaaaaccaatgcatgcttactcccaatagtgtacgttccattgaaaaggaacgattaaactcgttaactgcgggatttccgaacaaaaaattaggcacagatggtagaagtgacaaatgggacaaaaattcgacttggaagcctgtatatcgatcgtcgaatccttctcatcctagcactgaaaaaaatgtttccttgaatcaggaagccagtgctaaaccacttatgcttggaacctacagacagtttgatgcaacctcgttctacaaggttttaggcatctactataactttttccatattaattttcctgtaataccaattaacaaaagtaaatttactgacatgcttgatcctgaaaagccaaacgtgattgatgagatcagacaaattaacaatgaaattatccagtgttttaaaaccgcgctagaggtattggtattttgcaaaataaaacaaagaaggtcatcgaaatcaacaaaatcatggtctcgtgacagtttatgcgattttcaaaaaggtctgtattacattcagaatttcaacaaatgtatagccgactgcttccaaagtttaataactataaaacccgtattaaaacaaaattccagtgttattccttcaagaataaagttcatttacttttcgacaataatagtgttaaattttatcttaatattggccggtgaggaaagctcgcttttgctaggcccctctgttggggtttttaacgaatttcaagctcataagttatttctaccttttcaaaatacgtccccaatgctattattaaattcaaacgaggaaagtggtgacgagatactggattatgctgtgttgttcaaaaggttgtacatccttttaaacattctggatacgctacaaagctttcggctaggtcaaccaaaattaattaatctaaattttggtagcgccattgaaacatattttagcgataaaacaggtcataaccaagtcgtcgaaaaagctcccgtagctttggataacattctacgaaaccttaaacttggtgaatttataacatattttgtccttaacagaaaatcattgcaagtaaatgtacctcaccacttgctgttcacaaatcaaacggattacggagagttcgctgttgaaaaaggggaacatgataatatagctggcaaatttgagacccttttgaagaaaaaggaaattttaatcagaaaattactaaatattgaacagaaaaatgaccatattctagaaaattgctgcaattcggatgctgaaatgaaaaatatcggagagctagtctgctcaatgatcactctggtatcaggcatattagattcaattactaatatgaacgcagaaaactctgttgatttggattcaaagccccttccgaacgcctattttgctcaggacagtgaagaagaattaatgtcgccaacacaaagtattacgtcaaatcttgccagtgaagaaaatacacgttgcacaaccaaagacttgatgggaactgtttctattttcatgctgccaatggtggaagaatgctataatatcattagtttgataggacccatacctaccacattaataagtttatacatccgtaatggaaatatggccaagggaataaatgacagaattatgacgttgtcaactgcgctgaacgaattggtgcaaataaccgcactatttaataccctagaaccttttaggaagaatgcacatgaccgtgctaagcgttactatgtaagtgctacaagtagtaccggatgctacgaatcggtaatgaagagcatgtattccggaaaatgtgcagctagtaacgcctcaaacgttgcgccatcggaggaagaaaacaaaaagatattgaaaaagtttgccgacataggttggaaattgatggatgattcagaattgggttgttgctgttgcttctttaac

SEQ ID NO: 238 - protein, 919 aa, Saccharomyces cerevisiae
MSHHVPNLYGTPIRDPHERKRNSASMGEVNQSVSSRNCERGSEKGTKQRKKASHACDQCRRKRIKCRFDKHTGVCQGCLEVGEKCQFIRVPLKRGPAKKRGSVVSIEKFSSDNDPLQYRPRTHSYPMNSGNNYLPSLARNSSFPSISSLFVPSITAQSQQFVKVPYDDIKRRSSLAILGSDSSISTEFGGNYRLDENLNVRQEGKDIVAKGMITPVEEMGACSSNVRRQGSQSLPIQEQRASPYINPFISGRSRLSSLSYTSEATTSEGNTQGKNQCMLTPNSVRSIEKERLNSLTAGFPNKKLGTDGRSDKWDKNSTWKPVYRSSNPSHPSTEKNVSLNQEASAKPLMLGTYRQFDATSFYKVLGIYYNFFHINFPVIPINKSKFTDMLDPEKPNVIDEIRQINNEIIQCFKTALEVLVFCKIKQRRSSKSTKSWSRDSLCDFQKGLYYIQNFNKCIADCFQSLITIKPVLKQNSSVIPSRIKFIYFSTIIVLNFILILAGEESSLLLGPSVGVFNEFQAHKLFLPFQNTSPMLLLNSNEESGDEILDYAVLFKRLYILLNILDTLQSFRLGQPKLINLNFGSAIETYFSDKTGHNQVVEKAPVALDNILRNLKLGEFITYFVLNRKSLQVNVPHHLLFTNQTDYGEFAVEKGEHDNIAGKFETLLKKKEILIRKLLNIEQKNDHILENCCNSDAEMKNIGELVCSMITLVSGILDSITNMNAENSVDLDSKPLPNAYFAQDSEEELMSPTQSITSNLASEENTRCTTKDLMGTVSIFMLPMVEECYNIISLIGPIPTTLISLYIRNGNMAKGINDRIMTLSTALNELVQITALFNTLEPFRKNAHDRAKRYYVSATSSTGCYESVMKSMYSGKCAASNASNVAPSEEENKKILKKFADIGWKLMDDSELGCCCCFFN

SEQ ID NO: 239 - DNA, 1587 bp, Saccharomyces cerevisiae
atgtgcactccagatgaaaacgattacaaaacatcaactgacccagatacatctgcaaatacaaatcatactctcgaaaaaaagaagagaaaaaagagaaaaaacacaaacgtggcatgcgtgaactgttcgagattgcatgtgtcatgtgaggccaaaaggccatgcttacgatgtatcagcaagggcctcacggctacatgcgttgacgctccaagaaagaaaagcaagtacttggctggaataccgaatagagagctcccaatgaacatacaaccggaccttccaccccgcaagatcatgatacccatttataacaactccagcaatagtagcctcaacgtaaataacatgggagaacagcaaaaattcaccagcccacaacatatagttcacaaagctaaattcctatcgaatgctgcagattccgagtactctattctgtcgaatatcatctatcaagacacattgtctaacaagatccctattgacatcctgtactccaacaccaattccacatccaactccacaataggcaatagcagtaacaatagccctacgggcacaaatacaagccctgaagaaacagaaatggagaaaattcgccagttgtacagcgaacagcgagcaaacatacccccacatccgtatccatcttccaatcaaaacgtttattctattctactgggaccaaattcagccaagattgtagcttcgcaagttaatcttttcgcgaaccatttccccttagtgcccgttgattcagctgataattccttaaactttaaaagattattgccacgggacccatctgaaaagagctcccaaattaattgggactcaagcataaaccaatattacttgaacagcgaaacggtaacatttcccgagttggctatccccttaaagcggaggaaaaaccatttggtctctgtatccctggaaagctgttcaccagacgctgccaacatcaagagcaatgtagaatgggaacattcattacgttattctactccaatggaaatatacacctccataaatgcccccttttcgcatacacctggattccaccatcttttggtgtacctaaagcatcgattcaaccagcaggatctggtgaagatgtgtcggtccattgccgaattccggcccattttcattgcgtgttctgtaactttaaccgaggaggacatgatttttatggagcaatgctaccaaagaactctattagaatatgtaaaatttattgcacaaatcggtaccccgacatgtatttggcgaagaaatggtcaaatttcttatgtcaacgaggaatttgaaattctatgcggatggacaagagaggagctactaaacaagatgacttttatcgtagagatcatggacgatgaaagtgtacgcgattacttcaaaacgctctctaaagttgcatatagggacttcagaggatctgagaagatgaaagtttgcaggctcttaagccccatcaagggcaagataattcattgttgctgtatgtggacattaaaaagagatgtctctggtttgcccctcatgatcttgggtaacttcatgcccatactcaat

SEQ ID NO: 240 - protein, 529 aa, Saccharomyces cerevisiae
MCTPDENDYKTSTDPDTSANTNHTLEKKKRKKRKNTNVACVNCSRLHVSCEAKRPCLRCISKGLTATCVDAPRKKSKYLAGIPNRELPMNIQPDLPPRKIMIPIYNNSSNSSLNVNNMGEQQKFTSPQHIVHKAKFLSNAADSEYSILSNIIYQDTLSNKIPIDILYSNTNSTSNSTIGNSSNNSPTGTNTSPEETEMEKIRQLYSEQRANIPPHPYPSSNQNVYSILLGPNSAKIVASQVNLFANHFPLVPVDSADNSLNFKRLLPRDPSEKSSQINWDSSINQYYLNSETVTFPELAIPLKRRKNHLVSVSLESCSPDAANIKSNVEWEHSLRYSTPMEIYTSINAPFSHTPGFHHLLVYLKHRFNQQDLVKMCRSIAEFRPIFIACSVTLTEEDMIFMEQCYQRTLLEYVKFIAQIGTPTCIWRRNGQISYVNEEFEILCGWTREELLNKMTFIVEIMDDESVRDYFKTLSKVAYRDFRGSEKMKVCRLLSPIKGKIIHCCCMWTLKRDVSGLPLMILGNFMPILN

SEQ ID NO: 241 - DNA, 2496 bp, Saccharomyces cerevisiae
atggattcgattacagtaaaaaaacctcggttaagattggtttgcctgcaatgcaaaaagatcaaacggaaatgtgataaactgcggcctgcttgctcgcgatgccaacaaaattcattacagtgtgaatatgaagagagaacagatttatctgccaatgttgcagcaaacgactctgatggattcaattcctctcataagctcaatttcgaacagcaacctgtacttgaaaggactgggcttagatattccttacaagtgcctgaaggtgtcgttaatgctacgctgtcgatatggaacgccgaagatatgctagttatagtaggattagttacatttctggattatccttttgctgcgcatagtctggcgcaacatgaccagtatatcagggcactttgtgcttcgttgtacggcatggcgcttgttgactttagcaattatgctaatggtattccttgtgaagacacatcaagaagtatactaggaccattgtcattcatagaaaaggccatttttagacggatagaacatagtaagcaatttcgagttcagtctgccgccttagggttattatacaatgcattttcaatggaagaagaaaacttctcgactcttctaccgtcactcatcgctgaagtggaagacgtgttgatgcaaaaaaaagactgtgaaatacttttgaggtgtttctatcaaaatatttatcccttctatccttttatggacatttcactctttgagagcgatctcactagtttgcttttacaagacgacaataatcgttggaaaattagtactgaagttaaaaatgtgcgcaaaaaaatagaaactttgtcattacttacaatagtaatggccatggccttgatgcattcaaaattggatgcaaatcttctttcaatggtaaaagaaaatgcctccgaaagtgccaggaaactttctcttttatgtcataaactattatgcctcctggatgtatttcgctatccaaatgagaacacttttacttgccttttatatttctacgtttcagagcatttagatcccgagagtcccgattgtgtactgagccccactaacttgcttactctgcaccatcttttaaatttgtccatgaccttaggtcttcaatatgagccttcgaagtacaaacgtttcaaagatccagaagtgataaggcagagacggatattatggttaggagttcagtcattactttttcaaatttctcttgctgaaggtgatgctggtaaatcaaatagtgaatatatggaggcatatttaacagacttcgaagaatatattgaagcttcctcagagtatgaaaaaagttctgcgagtgaatcgaacgtgcaaatgaatgatattgtttggaataagtacaaatttcacgtcattttgagtaaactaatgtctgattgcacttcagttatacaacatccgcagcttttccacattttaggaaatattaaaagatctgaagattttatggctgagaactttcctacaagttcgatttaccaaccccttcatgaaaaggaaccaaatgcgatcaaagttggcaaaagtacggttctcgatgtcatggatattcaaaaaactgaaatatttcttacaaatattgtgggaagtatgtgttttttaaacatttttgatgtcctatcgttacattttgaaaaaaaatgtgttatgcactgggaagaatatgaaaagaactatcatttccttactttgaaaagtttcaatgcatacttaaagctagcagggttgatatctgattatctcgagaataagtttcaagggaacattttagagagtcgcggttatatcatagataaacaaatatgttttatgcttgtaaggatctggatgttccaatgtcgtattttgttaaggttttcatacaagcaagaaagtcagaaaaaattggcctcttccagtatatccactaacgataatgaaaaagaagatgaaatgattgtcattttagaaagacttattaaacacattcgtaaccaaatggcacatttagtggatctagcaaagggaaaacttcaagatagttactttggtgcttaccaaactgttcccatgtttagatacgttgtgtatttgatcgatgttggcggcttagtatctgtgacaaatgggttttgggataagatttccagtgatggtgaaataccgccaaaagtacaacaagccgtgagattgaaatggggattggactgcaataattcgagaagaatcaaacaaaagttaataagcagccagagtttgcagagtttcaatcaagttctgttgtgccagatggaggatgcagttctctccagttccttcgcaataaaagccaataccgctatgtcccaaaacacggctgaagaatttttcaatatcagcgaagaagaggctttaaatcaactattggaaaacaacaattttgatgccttctgggatttattaggtgaaaatctgagcgatatgccttctttg

SEQ ID NO: 242 - protein, 832 aa, Saccharomyces cerevisiae
MDSITVKKPRLRLVCLQCKKIKRKCDKLRPACSRCQQNSLQCEYEERTDLSANVAANDSDGFNSSHKLNFEQQPVLERTGLRYSLQVPEGVVNATLSIWNAEDMLVIVGLVTFLDYPFAAHSLAQHDQYIRALCASLYGMALVDFSNYANGIPCEDTSRSILGPLSFIEKAIFRRIEHSKQFRVQSAALGLLYNAFSMEEENFSTLLPSLIAEVEDVLMQKKDCEILLRCFYQNIYPFYPFMDISLFESDLTSLLLQDDNNRWKISTEVKNVRKKIETLSLLTIVMAMALMHSKLDANLLSMVKENASESARKLSLLCHKLLCLLDVFRYPNENTFTCLLYFYVSEHLDPESPDCVLSPTNLLTLHHLLNLSMTLGLQYEPSKYKRFKDPEVIRQRRILWLGVQSLLFQISLAEGDAGKSNSEYMEAYLTDFEEYIEASSEYEKSSASESNVQMNDIVWNKYKFHVILSKLMSDCTSVIQHPQLFHILGNIKRSEDFMAENFPTSSIYQPLHEKEPNAIKVGKSTVLDVMDIQKTEIFLTNIVGSMCFLNIFDVLSLHFEKKCVMHWEEYEKNYHFLTLKSFNAYLKLAGLISDYLENKFQGNILESRGYIIDKQICFMLVRIWMFQCRILLRFSYKQESQKKLASSSISTNDNEKEDEMIVILERLIKHIRNQMAHLVDLAKGKLQDSYFGAYQTVPMFRYVVYLIDVGGLVSVTNGFWDKISSDGEIPPKVQQAVRLKWGLDCNNSRRIKQKLISSQSLQSFNQVLLCQMEDAVLSSSFAIKANTAMSQNTAEEFFNISEEEALNQLLENNNFDAFWDLLGENLSDMPSL

SEQ ID NO: 243 - DNA, 2739 bp, Saccharomyces cerevisiae
atgagcgaagtcggtatacagaatcacaagaaagcggtgacaaaacccagaagaagagaaaaagtcatcgagctaattgaagtggacggcaaaaaggtgagtacgacttcaaccggtaaacgtaaattccataacaaatcaaagaatgggtgcgataactgtaaaagaagaagagttaagtgtgatgaagggaagccagcctgtaggaagtgcacaaatatgaagttggaatgtcagtatacaccaatccatttaaggaaaggtagaggagcaacagtagtgaagtatgtcacgagaaaggcagacggtagcgtggagtctgattcatcggtagatttacctcctacgatcaagaaggagcagacaccgttcaatgatatccaatcagcggtaaaagcttcaggctcatccaatgattcctttccatcaagcgcctctacaactaagagtgagagcgaggaaaagtcatcggcccctatagaggacaaaaacaatatgactcctctaagtatgggcctccagggtaccatcaataagaaagatatgatgaataactttttctctcaaaatggcactattggttttggttctcctgaaagattgaattcaggtatcgatggcttactattaccgccattgccttctggaaatatgggtgcgttccaacttcagcaacagcagcaagtgcagcagcaatctcaaccacagacccaagcgcagcaagcaagtggaactccaaacgagagatatggttcattcgatcttgcgggtagtcctgcattgcaatccacgggaatgagcttatcaaatagtctaagcgggatgttactatgtaacaggattccttccggccaaaactacactcaacaacaattacaatatcaattacaccagcagctgcaattgcaacagcatcagcaagttcagctgcagcagtatcaacaattacgtcaggaacaacaccaacaagttcagcaacaacaacaggaacaactccagcaataccaacaacattttttgcaacagcagcaacaagtactgcttcagcaagagcaacaacctaacgatgaggaaggtggcgttcaggaagaaaacagcaaaaaggtaaaggaagggcctttacaatcacaaacaagcgaaactactttaaacagcgatgctgctacattacaagctgatgcattatctcagttaagtaagatggggctaagcctaaagtcgttaagtacctttccaacagctggtattggtggtgtttcctatgactttcaggaactgttaggtattaagtttccaataaataacggcaattcaagagctactaaggccagcaacgcagaggaagctttggccaatatgcaagagcatcatgaacgtgcagctgcttctgtaaaggagaatgatggtcagctctctgatacgaagagtccagcgccatcgaataacgcccaagggggaagtgctagtattatggaacctcaggcggctgatgcggtttcgacaatggcgcctatatcaatgattgaaagaaacatgaacagaaacagcaacatttctccatcaacgccctctgcagtgttgaatgataggcaagagatgcaagattctataagttctctaggaaatctgacaaaagcagccttggagaacaacgaaccaacgataagtttacaaacatcacagacagagaatgaagacgatgcatcgcggcaagacatgacctcaaaaattaataacgaagctgaccgaagttctgtttctgctggtaccagtaacatcgctaagcttttagatctttctaccaaaggcaatctgaacctgatagacatgaaactgtttcatcattattgcacaaaggtctggcctacgattacagcggccaaagtttctgggcctgaaatatggagggactacataccggagttagcatttgactatccatttttaatgcacgctttgttggcattcagtgccacccatctttcgaggactgaaactggactggagcaatacgtttcatctcaccgcctagacgctctgagattattaagagaagctgttttagaaatatctgagaataacaccgatgcgctagttgccagcgccctgatactaatcatggactcgttagcaaatgctagtggtaacggcactgtaggaaaccaaagtttgaatagcatgtcaccaagcgcttggatctttcatgtcaaaggtgctgcaacaattttaaccgctgtgtggcctttgagtgaaagatctaaatttcataacattatatctgttgatcttagcgatttaggcgatgtcattaaccctgatgttggaacaattactgaattggtatgttttgatgaaagtattgccgatttgtatcctgtcggcttagattcgccatatttgataacactagcttatttagataaattgcaccgtgaaaaaaaccagggtgattttattctgcgggtatttacatttccagcattgctagacaagacattcctggcattactgatgacaggtgatttaggtgcaatgagaattatgagatcatattataaactacttcgaggatttgccacagaggtcaaggataaagtctggtttctcgaaggagtcacgcaggtgctgcctcaagatgttgacgaatacagtggaggtggtggtatgcatatgatgctagatttcctcggtggcggattaccatcgatgacaacaacaaatttctctgatttttcgtta

SEQ ID NO: 244 - protein, 913 aa, Saccharomyces cerevisiae
MSEVGIQNHKKAVTKPRRREKVIELIEVDGKKVSTTSTGKRKFHNKSKNGCDNCKRRRVKCDEGKPACRKCTNMKLECQYTPIHLRKGRGATVVKYVTRKADGSVESDSSVDLPPTIKKEQTPFNDIQSAVKASGSSNDSFPSSASTTKSESEEKSSAPIEDKNNMTPLSMGLQGTINKKDMMNNFFSQNGTIGFGSPERLNSGIDGLLLPPLPSGNMGAFQLQQQQQVQQQSQPQTQAQQASGTPNERYGSFDLAGSPALQSTGMSLSNSLSGMLLCNRIPSGQNYTQQQLQYQLHQQLQLQQHQQVQLQQYQQLRQEQHQQVQQQQQEQLQQYQQHFLQQQQQVLLQQEQQPNDEEGGVQEENSKKVKEGPLQSQTSETTLNSDAATLQADALSQLSKMGLSLKSLSTFPTAGIGGVSYDFQELLGIKFPINNGNSRATKASNAEEALANMQEHHERAAASVKENDGQLSDTKSPAPSNNAQGGSASIMEPQAADAVSTMAPISMIERNMNRNSNISPSTPSAVLNDRQEMQDSISSLGNLTKAALENNEPTISLQTSQTENEDDASRQDMTSKINNEADRSSVSAGTSNIAKLLDLSTKGNLNLIDMKLFHHYCTKVWPTITAAKVSGPEIWRDYIPELAFDYPFLMHALLAFSATHLSRTETGLEQYVSSHRLDALRLLREAVLEISENNTDALVASALILIMDSLANASGNGTVGNQSLNSMSPSAWIFHVKGAATILTAVWPLSERSKFHNIISVDLSDLGDVINPDVGTITELVCFDESIADLYPVGLDSPYLITLAYLDKLHREKNQGDFILRVFTFPALLDKTFLALLMTGDLGAMRIMRSYYKLLRGFATEVKDKVWFLEGVTQVLPQDVDEYSGGGGMHMMLDFLGGGLPSMTTTNFSDFSL

SEQ ID NO: 245 - DNA, 2655 bp, Saccharomyces cerevisiae
atggatattcgtggtagaaaaatgaaaaaaccgcctgcatgcgtgcagtgccgtaagaggaagataggctgcgatcgtgttaagccgatttgtgggaactgtatgaagcataataaaatggactgcttttatccggacgttcccggacaatacgttccctctagttcttcctcttccaatacacgccaagtagccaacggtccgtacttaaactcttattacgcttctcgtcgtgtctccaaggaaactgctgcacttttgcagaaaaatccagaactggcttctttggagcaaataagagaatacaacacgcgtctgcaactgctcaatgctcaaaatcaacttaataatagatcatctgcggcaaatgcaaccttgaatcaacaacacactcaatatattccaaaatcagtgccttccttggaaagtaagccagtcacttctgcaaacgaatcttctactccactcaattgggttcaaggccctgcaatttttcatatgctaacctctccttacacacaagatgaaatcatcaatcatgaaatgaatttcttgaaaggcagactactggaattgcaagaaattacaggtaagaaaattacgggagtaaatcttgatctcaagcaggattcctcagcgcaaatgcagtcttcacactccaatagaaaccaagaggagtttttgacaattaagaaaagaaaactgagtgaagacggcgttacggacggggacggtaagccaattccagagagtgaaagaagacctcatcttaatgaatttaaggatttagatcctcaatttttggatactaataaagtttttaatgtgtttaattctgctatttcagaagaaggtagaaacagattatggctgttaccaaaaaatataaataaaagttctatcttccagattcagtatttgattgaacgtgatcctttcctattcaaattcttcaatgacttgaatatattaattgaaacgcaatttaatggacctttgcacgatttggtagcaagccgtaacagtattgagcgcaacagtggcatatctcaaatattaaagtttccttcacaatcgataacacagacccttatcaacaaatacttatccacgataacggaaacgaattcaatacttccaatattaaaaccaaagagactattacccatagttgagcagctttttccttctaacaccattaataagccaaattctaaagattttgaaactatttttcaagtttttagtgtgaccaatgatcagctactaaatctaggatttattactctctgtctcctgattctttttgaatcgttgaattctacggttttgattcctcttagagatgatgaacacttgcaattattcaatgtgttattcaactacttgcctttgttgaagtctaatttaacaacgcttagatttgaaattgaaaaaaggtcaatgtgtaatatagagaccctgcggtttatttctttgtggaaatattaccaatttgtgatggacacgtcgtcatcgtcctctttcgtaattgattacgacgaagatatgcatatggcatgtttactatcgttaaatcatgaaactcaaaatcaatctcatattttgacctggaatttcatatttaagaactactgctggagacaccttttcttaggtcaattgccgttgctaatgtctgaacctttcacaaattctaccccaattattgatcctttgttgaacaacgattttgaattgattgattttgaagtaaacttgatgaaatatttgcaaagtaaagatcaacaactatccattgataaaattatacagttaatcaagcttttgaaaaataagaatatcgaggtcagccaaggatgtttaacgactccttcaataattaataatatcatggattctctaatctacaggaattcaatgttatatttgaacttttacctcttattgcaatttgaaacattgaaaaattatgctaaatttaacgaaattttggaagactttttggaattgtcgagggagaccttgttctttgttttctcgaacttagccaatattaaatttgctggtcatgaattcacattcatcaataaatctattgtggttctgcaaactttagttttaatgcttttggcgctctatcaaaggtcttttgattcttcaaagaggacgaatgatgctaatgaaatcagtgagcaaacagatattcatagtaataacgacaatagtaagagaataaagaataaaaatgttattcatttaattatcaacaaaattgcaatgttgttaagtgattataccaagaattgtaaaaagcaaaataaactcatcgaaaatctgattattaaaattaagacaatctccaagtatatcaaaaatcttgaggagaataaggtaacgactagcgccgattcaaattattccattaataacggattttctggcatatctgcagagcagttgattaaattaaatcacgagttgagtaaaatttcagaatctctgataaaaacggatttttatgaacagaggaaaaatagcacagtttctaatggagttttaggcgcagcagctcctgttgatagcgacgcaaattcggatactttcggtttaacaaaggagaatttcaacgaagtttttgaggctattcgtagc

SEQ ID NO: 246 - protein, 885 aa, Saccharomyces cerevisiae
MDIRGRKMKKPPACVQCRKRKIGCDRVKPICGNCMKHNKMDCFYPDVPGQYVPSSSSSSNTRQVANGPYLNSYYASRRVSKETAALLQKNPELASLEQIREYNTRLQLLNAQNQLNNRSSAANATLNQQHTQYIPKSVPSLESKPVTSANESSTPLNWVQGPAIFHMLTSPYTQDEIINHEMNFLKGRLLELQEITGKKITGVNLDLKQDSSAQMQSSHSNRNQEEFLTIKKRKLSEDGVTDGDGKPIPESERRPHLNEFKDLDPQFLDTNKVFNVFNSAISEEGRNRLWLLPKNINKSSIFQIQYLIERDPFLFKFFNDLNILIETQFNGPLHDLVASRNSIERNSGISQILKFPSQSITQTLINKYLSTITETNSILPILKPKRLLPIVEQLFPSNTINKPNSKDFETIFQVFSVTNDQLLNLGFITLCLLILFESLNSTVLIPLRDDEHLQLFNVLFNYLPLLKSNLTTLRFEIEKRSMCNIETLRFISLWKYYQFVMDTSSSSSFVIDYDEDMHMACLLSLNHETQNQSHILTWNFIFKNYCWRHLFLGQLPLLMSEPFTNSTPIIDPLLNNDFELIDFEVNLMKYLQSKDQQLSIDKIIQLIKLLKNKNIEVSQGCLTTPSIINNIMDSLIYRNSMLYLNFYLLLQFETLKNYAKFNEILEDFLELSRETLFFVFSNLANIKFAGHEFTFINKSIVVLQTLVLMLLALYQRSFDSSKRTNDANEISEQTDIHSNNDNSKRIKNKNVIHLIINKIAMLLSDYTKNCKKQNKLIENLIIKIKTISKYIKNLEENKVTTSADSNYSINNGFSGISAEQLIKLNHELSKISESLIKTDFYEQRKNSTVSNGVLGAAAPVDSDANSDTFGLTKENFNEVFEAIRS

SEQ ID NO: 247 - DNA, 2850 bp, Saccharomyces cerevisiae
atgtctgctaagaaaaggccttcgggaaacgcagcatttgaacttccaaaacggagaagaacctaccaagcttgcatcagctgcagatcaaggaaggtgaaatgtgatcttggtccggttgataacccacacgacccaccgtgtgcacgttgcaaaagggagctaaaaaaatgtatttttagctctaataagggaacttcgaacgacttgcctcctaattcgattaatgcaataagtctgccatctctaggtaagagtaagcaagagatacaaaatgactcaacgagcccaattttatcggatgtacctttgtcaagaaaagggattagcagtgaaaaatcatttaaatcagaagggatgaagtggaagcttgaactttcctccatgcagaacgccctagagtttctggcccaagctgctggaactgtagcaaaagaaggcgcaaaagaaatcataaaagagaagtccacaacaccgaaaccactgaaaagttctttggatgcgacaaataaatctgctacggacgaggggttgaaacgactttcaaaaagtgacagtactaacacactttacgaaaatacagcagatatgcttaaccacacgctgaatacgaataggaaaacatcacaattaatggaagaaatcgggaaagtgagacctccacctacccggaaaattgacgacttcgattacatcggtccagatagcttgcttactaaagaggaggcgattgaactcatagaggcattttttctcacgatgcacccattctttcccaatatcccacttcaattgcatgatccgaaagaattagcagaatatccaattttgttttgtgcaattttgactgtttctgctcgctatcatcctttcgatactttaggattagacaatggagaagatgggatgagacacattgaagttcacgataaattatgggtgtattgccagaagcttatatctcaaacaatttgggcagaggctagtactaggtcaattggcaccgtgcttgctttcataattttcacggaatggaacccaaggagtatccactataaatggtctgactatgcaaatgatcctgagttaaataatgtcaacgctagaggaagtaagaatattagtacgaggaaggacgaagaaggattgaccggtgtcggcgcaatccgtagaagcgaccgaatgtcatggatgctgacagggtctgcagtaaggctggcgcaagatatgggattcattgaaaacagctcaaaagtattcattgtcactcatatatctgagactaccagtgctatgaatatgaatcaaagatccttattagcagaatcattcagcgttttaaacttgaatttaggaaaaattgaaaacgatggaaatgaaagcaatgaggattaccttgggaatgaaaaattttatctgaatgagattttgcctgatgaagaaagtaaactaaggtggaagagagtttttgaaaactcagaaaatgaccacgacaacgagaaaaattttttgactgattgggagagggagtttttaaacgatgagtatgttctatattattctaataaaaaagatgatactaatctagcacagaatcacataccaccatttccactaagattctcattcgcccaaagagcaaaaatagagatcattcgaatcctatccatagcatatgagacgatttactgtgagaagaataagaggaaattggcaacgacagatcagagacacaacctctctgtcctaagtgttttttctcccttgatagagggctggctcagtaactacagagagcttcttgtacccctttctgatgtccctttctcactagcagataggaagaacaaaaaacaaatatttgataacatcgatagaataaatggtgaaagtattatcacagatttcaattattgtcaactttatatcttttccctcgcactgcaagtggatgggaaaacaagcagattgaatatgaatgaaattgtgacaagcgcgaggtatgtggaattagcatacagatctgcaaaagaaatattgagttctgcaaagcgagtttcaaggcaaggaatgctaaaatacatgcccgtaagatgggtaatacgaataattagatccattgcgttcatagtaaaatgctacctaacacttactggtagtgaactggcaacaaatccagatgccagaaacattttaaaattaagtgcaatatcggttgacgaaacattcgatatcatccgtgacactgcggttactttgaaagaagctacaccagatgaattacatctatgtcaaagatacgcagccatattaatgtacttatgtacagagatgaaacttcgaaaaaaatcttacttagaacgaccacccttattaagagatggcaccactcctctagagagcaatcgcgaatcctcactggagggacaagacttaactaagaagccaatattctctaaacgtattggatataataaaaccgagactacttttgaaccctcggaaaggcctttgacggaggaaattaatagcaattctcagaattcaaatgatacatcttctaaaggtatcgttgatccttttgttgaacaaaacaacgatatcacaacagcgttactgaacaatgaactcttccaaggtccatctctatctgacgaggttacagattggttcggtgctagtgaagatatcgggcttgaatttgtagaaccatggacagaacttattgagcaacgatatatgcaatgtggagatggtgataataataatttcgaaaatttatacaacttgttcgtgaatagtaataacatcaataatgatattaataactcaaggccaataacgcgtaaa

SEQ ID NO: 248 - protein, 950 aa, Saccharomyces cerevisiae
MSAKKRPSGNAAFELPKRRRTYQACISCRSRKVKCDLGPVDNPHDPPCARCKRELKKCIFSSNKGTSNDLPPNSINAISLPSLGKSKQEIQNDSTSPILSDVPLSRKGISSEKSFKSEGMKWKLELSSMQNALEFLAQAAGTVAKEGAKEIIKEKSTTPKPLKSSLDATNKSATDEGLKRLSKSDSTNTLYENTADMLNHTLNTNRKTSQLMEEIGKVRPPPTRKIDDFDYIGPDSLLTKEEAIELIEAFFLTMHPFFPNIPLQLHDPKELAEYPILFCAILTVSARYHPFDTLGLDNGEDGMRHIEVHDKLWVYCQKLISQTIWAEASTRSIGTVLAFIIFTEWNPRSIHYKWSDYANDPELNNVNARGSKNISTRKDEEGLTGVGAIRRSDRMSWMLTGSAVRLAQDMGFIENSSKVFIVTHISETTSAMNMNQRSLLAESFSVLNLNLGKIENDGNESNEDYLGNEKFYLNEILPDEESKLRWKRVFENSENDHDNEKNFLTDWEREFLNDEYVLYYSNKKDDTNLAQNHIPPFPLRFSFAQRAKIEIIRILSIAYETIYCEKNKRKLATTDQRHNLSVLSVFSPLIEGWLSNYRELLVPLSDVPFSLADRKNKKQIFDNIDRINGESIITDFNYCQLYIFSLALQVDGKTSRLNMNEIVTSARYVELAYRSAKEILSSAKRVSRQGMLKYMPVRWVIRIIRSIAFIVKCYLTLTGSELATNPDARNILKLSAISVDETFDIIRDTAVTLKEATPDELHLCQRYAAILMYLCTEMKLRKKSYLERPPLLRDGTTPLESNRESSLEGQDLTKKPIFSKRIGYNKTETTFEPSERPLTEEINSNSQNSNDTSSKGIVDPFVEQNNDITTALLNNELFQGPSLSDEVTDWFGASEDIGLEFVEPWTELIEQRYMQCGDGDNNNFENLYNLFVNSNNINNDINNSRPITRK

SEQ ID NO: 249 - DNA, 2316 bp, Saccharomyces cerevisiae
atggatataaactcaaatgcctcagtaagccccagaccagatggtttaccgatgactgctggatataattctgcttctggaaaggtgcgaaatagtatcagatccataataaaccacccagaggatagtgcaagagccaaagagcgcagtgaaacgaacagtcctaagaataatggcaacaaaaaacctagaaagaaaagaaaaacatttagttgtgatacttgcaggagagtgaagacaaggtgcgattttgaacctttcattggaaaatgttacagatgtaacgttctgcagcttgattgctccttagccaggaataaagacaatgaaattttgaatactttacgtgaggatggtctactaaagaagatcaactcaattaatcacaaccttggttctttctctcatttgaatgcggactctcccaacgaaagccaaagtagttttgaaaagaatggaacggtcaattttgataattacatgatcgataaaaggctttcatctttagaagagcacataaaatctttacaccagaaaatggacttgataatcaccacagcaaagatgtcttataacagcgatatcaaaggccctggagatgatattcagaacgtggatttcagctcaaataagacgtacgatagtcgtctaacttcgggctcagagacgataaggaaaacaggggaatatagaaaagaaaatcttttcttaaatggatttaagttgaaggaatctcctttaaaattgctacatgatattgatgagaggctatttccatcgaaggctacatctaaagctgcgaagctagctggacagcaaaggccatatgctgttgcaagagtgaactttctccatttttatgagaataatcaggaattatgccataagcttgcaaaagaatttctggtgagatcccatttctggataattccaggtgggagaaaagagatagacgtggaatatgcccactcacacctatttattacaagtgtttttactattatcgctatgagttttgctgacaacgataaatacgctgcagaacaagaaatattgtatcctttagtggagagattactcactaatacgttaaccatgtttgaaaagttaacagcgtttgatattgaggctattttatattgctgtatgttccatatttcgcgaaaggcaaagagatataggcaactgaagtttaattctctggtactaagcaattttgcgctcaatagcttgttacatgtaatagatttttatcagataaaggatagggttttggtaaaagaagtgtataatcccgaagatctttatcatctaagaatactaaattcactaactgcctgctatttagaatattccattagttacggcgatattagggaacaggatgatatgcttaaagagtttaataaacttgtggcgaaatttcctcaggcgaattttggtgatgacattaaaatcagtgagataaatttaggtgacatcgtaaatggcatctttataaaccttaaaaattattttgcgcagtgtttggatgactttaacaatgacagatatggaggtaacgcagatacttttatctttgtttttccagagctaaattattggctgaaaaattgggaagagcttttagcaaaggatggcgcgggcgtgctattgttcacatttgatttttatcatatcatgatatgtcgcacttttatcacagaattttcttccacgctaaaaagcaaccaaaggtttttgaaactaattcttaatacgatgaaagaacattcattttcgctgttgaatgggtttttgagactaccgccaacgttaataaggggtgctccgatttttacttgtcatcaactagtctacgcctgtttaactctttgtgactatctttattggttcgattcttctgaacgtcaacgcgttttgagtctttgtacaaaagtgtactggcatttgagcactataggggaaaaaatgaatgaggctactgataacgttggaaaaatcataaaatctataattgatactagtaagactcgtattaattttggcagtttgtcaaaagagaatagtgataatgataaaatgtcgactaatgctaataactacacaggagcaggaaatctgcacgccgcgaaacccgctacttcgcctactaatgttggtactttgcacgagaacttgtccagtagtcacttcatgattcctgacgtcgaccaattcaattcctttgaagacttttttcaggatttttttgatagtttaaaaccaaattcccaaaaaatgtttaccagcgataagaagactgaacaaactact

SEQ ID NO: 250 - protein, 772 aa, Saccharomyces cerevisiae
MDINSNASVSPRPDGLPMTAGYNSASGKVRNSIRSIINHPEDSARAKERSETNSPKNNGNKKPRKKRKTFSCDTCRRVKTRCDFEPFIGKCYRCNVLQLDCSLARNKDNEILNTLREDGLLKKINSINHNLGSFSHLNADSPNESQSSFEKNGTVNFDNYMIDKRLSSLEEHIKSLHQKMDLIITTAKMSYNSDIKGPGDDIQNVDFSSNKTYDSRLTSGSETIRKTGEYRKENLFLNGFKLKESPLKLLHDIDERLFPSKATSKAAKLAGQQRPYAVARVNFLHFYENNQELCHKLAKEFLVRSHFWIIPGGRKEIDVEYAHSHLFITSVFTIIAMSFADNDKYAAEQEILYPLVERLLTNTLTMFEKLTAFDIEAILYCCMFHISRKAKRYRQLKFNSLVLSNFALNSLLHVIDFYQIKDRVLVKEVYNPEDLYHLRILNSLTACYLEYSISYGDIREQDDMLKEFNKLVAKFPQANFGDDIKISEINLGDIVNGIFINLKNYFAQCLDDFNNDRYGGNADTFIFVFPELNYWLKNWEELLAKDGAGVLLFTFDFYHIMICRTFITEFSSTLKSNQRFLKLILNTMKEHSFSLLNGFLRLPPTLIRGAPIFTCHQLVYACLTLCDYLYWFDSSERQRVLSLCTKVYWHLSTIGEKMNEATDNVGKIIKSIIDTSKTRINFGSLSKENSDNDKMSTNANNYTGAGNLHAAKPATSPTNVGTLHENLSSSHFMIPDVDQFNSFEDFFQDFFDSLKPNSQKMFTSDKKTEQTT

SEQ ID NO: 251 - DNA, 2382 bp, Saccharomyces cerevisiae
atggcagcaaaaagaggattagccaaacaaaaatctagggtaaccaaggcctgtgatagatgccataggaaaaagattaagtgcaacagtaagaagccatgttttgggtgtattgggtctcaatcaaaatgtacgtatagaaatcaatttcgtgaaccgattgaggcttttttcaattatactggtagtctcagtaatgatttggataatgctaagtgcagcatagcaaaattgaaggcacagttacctccaagcgcaccggcctctttacagaaaggcctagcaaacatttgcactgagcttgaaaaaatacaacctcagctttacctcaatctggacagtaaggaaattagctcgtatggtggcctgaaatcgatagaaacagaaattatcgggaaacagtcaaaatctttgaataggttctccaacgcttttgaaagcaatactgcacaaaatgtcagtatgtactttggggtctattcaccgttgctatattttgcctctacgggtattagctggataactaaaaaattgatttcatgttcgaatgatagggagacgagagaaactatctatttatttttgaagtttcttgacgctagctctgctagccatgctggtcctaaagtaacttcgatatctcctttagagtattattcaaagctaaacggactttcatgtgggaacgacgtacttattcaacacattatgtcaaatatatcgaatgaaatcaaaggaaatacaaacattaaccaaacaatcaaattcaataaaccaacagactggtttatgtacggagtacaattgatggaacagcaccacaaggcgttggatcgtaaaagttccaaaaaattacttcctttgaaatattttcttgagcaagatgagttgattttttgtctctgtcttgaatattttgaaagatccctattttcgacaatgtacgacttgactattttaaagggcttagtctcgttgatgaaacacagatattggatagacgatccttttgtgctgggaagaattatttccacgatgtccaggcgaagtttggatgctggtttgaatcgttgggaatattatattggtcaggatgaggacactgccgaagaatatcgtaagttatggtgggactgctactggtgggatagatggtattcattggtcaccggtaagcagccattgataccacatgaaatgacttcgtgtctctttcccaaggatgtggttggattaggggtagatgattcgatggactgttttactttaataaacttggtggagctcgacccaagtaagtttgatatttgtatctctttcggctatattctattaacgaaaattattacagcggtattctctggtttgctttataatcgacactttacagactacagattatttgcaactcctaacgctaaagacctaaatggaaccgcacgacagcttatggtagagttttcaaaaatatgtaaaatttttcagtgcatacaagacaaactaatccctttcctcaaacaatattctgaaaatagtaatgtatttgaactatacacccatttcggatttgcaaaggtttgttgttttcagggaatggagagtttaattttaaggatacaaaatcttctacaagaaagagagagaattgaacttgattcctgcgtaaaggacatcaggcttcaaacctttgaagcatctgtagatattttgacggatgttctcaagcacgaagatacgttctatattttccgttgttcgtggttcatatatgccatcttgatgaatattaccttgaattttatcgagacccctagaaggaactcgatatgttatttatccttgatgtgccgcatgatagcctcatataatgacttatttgtgagctctggcaatgttaatttcaagggcaacaacgccttctctaaaaagttggaaaatggaacagcggtttctttcatcctaacacgcatctgctgtcagatgtacacacgttcacagaaaatggctaaggaatcgctgttttgtgaattgaaaaaatatggccaggcttgctcagatgctggtcaagctgcgttggacattgaatgtatctggtacaggaatattataggcgaacacaaagaatcaagcttccgtaaagaaattctcagcattcttgatagggaaatgggtgatttggtgaataatagagttattggcgtacagggaaaaaatcaagaaggtgcttgttatgagaagttgtcacccagcagcaccagtgtttcagttggcatggacttttgtagcctcgaaaattttgtgactgcagaatctctaccagaccttctcaatctattttgggaggacactgaatttggtattactaaagaaaacctcggagag

SEQ ID NO: 252 - protein, 794 aa, Saccharomyces cerevisiae
MAAKRGLAKQKSRVTKACDRCHRKKIKCNSKKPCFGCIGSQSKCTYRNQFREPIEAFFNYTGSLSNDLDNAKCSIAKLKAQLPPSAPASLQKGLANICTELEKIQPQLYLNLDSKEISSYGGLKSIETEIIGKQSKSLNRFSNAFESNTAQNVSMYFGVYSPLLYFASTGISWITKKLISCSNDRETRETIYLFLKFLDASSASHAGPKVTSISPLEYYSKLNGLSCGNDVLIQHIMSNISNEIKGNTNINQTIKFNKPTDWFMYGVQLMEQHHKALDRKSSKKLLPLKYFLEQDELIFCLCLEYFERSLFSTMYDLTILKGLVSLMKHRYWIDDPFVLGRIISTMSRRSLDAGLNRWEYYIGQDEDTAEEYRKLWWDCYWWDRWYSLVTGKQPLIPHEMTSCLFPKDVVGLGVDDSMDCFTLINLVELDPSKFDICISFGYILLTKIITAVFSGLLYNRHFTDYRLFATPNAKDLNGTARQLMVEFSKICKIFQCIQDKLIPFLKQYSENSNVFELYTHFGFAKVCCFQGMESLILRIQNLLQERERIELDSCVKDIRLQTFEASVDILTDVLKHEDTFYIFRCSWFIYAILMNITLNFIETPRRNSICYLSLMCRMIASYNDLFVSSGNVNFKGNNAFSKKLENGTAVSFILTRICCQMYTRSQKMAKESLFCELKKYGQACSDAGQAALDIECIWYRNIIGEHKESSFRKEILSILDREMGDLVNNRVIGVQGKNQEGACYEKLSPSSTSVSVGMDFCSLENFVTAESLPDLLNLFWEDTEFGITKENLGE

SEQ ID NO: 253 - DNA, 1395 bp, Saccharomyces cerevisiae
atggcccgcaatagacaagcgtgcgactgttgttgcattcgtcgagtaaagtgtgatcgtaaaaaaccatgtaaatgttgtcttcaacacaatctgcaatgtacatatcttcgacctttgaagaaaagaggtccaaaacccgtcaaggtgagaaatttaaagaaagtagatgatgtacaggtatttagtaaaagtagtagtggtggcataatgaaggttccaaaggcactaattgatcagtgtctgcggctctataatgataagttgtatgtgatctggcctttgctgtgttatgatgatctttacgaacttttagagaaaagatatgacgaaacctgtgtgtattggttcctggtatctctttctgccgccacgcttagcgatttgcagactgaaattgagtcggaaggaggggttacctttactgggatacagttatccagtttctgcatgtcatcacgccaagaatttgacgattttaacggtagtgatatattcaagattatgacgtactattgtctaaaccgctgctacgcacagatgtccaactcaagaacttcgtatcggctttcttgtgaagccgtggggctcattaagttggcggggttccatcgcgaggaaactttgaaacttcttcctttcgatgagcagcagcttggaaggaaagtttattatttgcttctcttaacggaaagatacttttctgtgtatacgcattgcgccacgagcctggataccacgattgctccaccacaaccggagaacgtaacggacccccgactatctctcgacagcttcttggagatgattagggtatttactgtaccgggaaaatgcttctttgatgctctagctaccgactctgctaatgtaacctgtactgaagactcccttaaaaagatatggagggaacttcatacggtgccacttgagatagaaccatggtcttacggctatgtagacatatctttttcacggcattggattagaacacttgcttggaagctagtgcttcaaataagcggtatgcgaatcagtttcctttcaaatagcaagaatacgcatattccagtagaaattgctagagacatgttagaagacacatttttaatcccaaaaaatctttatgcagttcacggtccagggatatcagtgaaagcactagaaatagccgacgcattggtagatgttgtgaatcagtacgatcaaaatgcagagtcggaggcttggaattttttgttcgatatatccaaatttgtcttctctcttaagcattgtgatagcacattagttgataagtttacgacaaagtgtcagtgtgcgcttatcacgcttcctctttctaatccgcttgaatcgacagatggttctaaagaagatgtagatgcgcttcct

SEQ ID NO: 254 - protein, 465 aa, Saccharomyces cerevisiae
MARNRQACDCCCIRRVKCDRKKPCKCCLQHNLQCTYLRPLKKRGPKPVKVRNLKKVDDVQVFSKSSSGGIMKVPKALIDQCLRLYNDKLYVIWPLLCYDDLYELLEKRYDETCVYWFLVSLSAATLSDLQTEIESEGGVTFTGIQLSSFCMSSRQEFDDFNGSDIFKIMTYYCLNRCYAQMSNSRTSYRLSCEAVGLIKLAGFHREETLKLLPFDEQQLGRKVYYLLLLTERYFSVYTHCATSLDTTIAPPQPENVTDPRLSLDSFLEMIRVFTVPGKCFFDALATDSANVTCTEDSLKKIWRELHTVPLEIEPWSYGYVDISFSRHWIRTLAWKLVLQISGMRISFLSNSKNTHIPVEIARDMLEDTFLIPKNLYAVHGPGISVKALEIADALVDVVNQYDQNAESEAWNFLFDISKFVFSLKHCDSTLVDKFTTKCQCALITLPLSNPLESTDGSKEDVDALP

SEQ ID NO: 255 - DNA, 2892 bp, Saccharomyces cerevisiae
atgccagaacaagcgcaacaaggggaacagtctgtcaagagaagaagggtcactagagcctgtgatgaatgcagaaagaaaaaagttaaatgtgatggtcagcaaccatgtatccattgtactgtgtactcttatgaatgtacttataagaagcctacgaagagaacacagaactccggaaactccggagttctaacactgggcaatgttactactggtccatcatcaagtactgtggtggcagccgccgcttccaatccaaataaactcctctcaaacattaaaacagaaagggctattttaccgggtgcttctacaatacctgcaagtaacaatccatctaaaccaagaaagtataagactaagagcacaaggttacaatcgaagattgacaggtacaagcaaatatttgatgaggtcttcccgcagttacctgatatagacaatctggatattcctgtgttcttgcagatctttcacaattttaagagggactcgcagtcgtttttagatgacactgtgaaagaatatactttaatcgtaaatgacagttcttctccgatccaaccagtactttcttcaaattcaaaaaactccactccagacgaatttttacctaacatgaaaagtgactcgaatagcgcctccagcaacagggaacaagacagtgtagatacctactccaatatccccgttggtagagaaataaaaataattctaccaccaaaagcgatcgctttacaattcgtgaaaagtacttgggaacattgctgtgttcttctccgattttatcacagaccatcgttcattagacaattggatgagttgtatgagacagacccaaacaattatacgtctaagcaaatgcaatttttaccattgtgctacgctgcaatcgctgtgggagcattattctcgaaatccattgtctcaaatgactcgtcaagggaaaagtttctacaggatgaaggttacaagtacttcattgcagcaaggaaactaatcgacattacaaatgcccgtgacttgaattccatacaagcaattttaatgctgattatattcttacaatgttccgcacgtttatcaacgtgttacacttatatcggtgtcgccatgagaagtgctttgagagcaggctttcataggaaattgagccccaattctggttttagtccaatagaaattgagatgaggaaacgccttttttatacaatctataaactggacgtttatatcaatgcaatgctgggcctaccgagatctatttcccccgacgattttgaccaaactctccccctggatttatcagatgagaatatcactgaggtggcgtacctacctgagaaccaacactccgttttatcaagtacggggatttcgaatgaacatacaaaactatttttgattttaaatgagatcatttctgaactatatccgataaaaaaaactagtaatataatttctcatgagacagttactagcttggaattaaagttgagaaattggttggattcgttgcccaaagaactgatacctaacgcagaaaatattgatcctgaatatgaaagggcaaatcgtttattacatttgtcttttttgcacgttcagataatattatacaggccttttattcattatttatcacgcaacatgaatgctgaaaatgtagatcccttatgttaccggagagcccggaactctattgccgtggctcgaacggttattaagttagcaaaagagatggttagtaataatttattaactggttcatactggtatgcctgttatacaattttttactccgttgcaggtctcttattttacatccatgaggcgcaattgcctgataaggatagtgctagagaatattatgatattttgaaagacgcagaaactggtagaagcgttcttattcaactcaaggattctagtatggccgctagcaggacttataatttattgaaccaaatttttgaaaaactaaactcaaaaactatccagcttactgcgttacattcatcaccatccaacgaaagtgcctttttagtgactaataattcctccgctttgaaacctcatttaggagattcattgcaaccacccgtattcttttcttcccaggatacgaagaatagcttttcattagctaagagtgaagaaagcaccaatgattacgctatggctaattacctaaataatacacctatttccgaaaatcctttaaatgaagcacaacagcaagatcaagtatcccaaggaacgactaacatgtctaatgaaagagatccgaacaatttcttatctattgatatcagacttgataataatggccaatcaaatattcttgatgccacagatgacgtctttatcaggaatgacggcgacatccctactaacagtgcattcgattttagcagcagtaagagcaatgcatcaaataactccaacccagataccattaacaacaactacaataatgttagtggcaaaaacaataataacaataatattactaacaatagtaataataatcacaacaacaacaacaacgacaacaacaacaacaataataataataataataataataataacaataacaatagtggtaatagtagtaataataataacaataataacaataataaaaataataatgacttcggcattaagattgataacaattcaccgtcttatgaagggtttccccagttacaaataccgctttcacaagacaatttgaacatagaagataaagaggagatgtcacctaatattgaaattaaaaacgaacaaaatatgactgactcaaacgatattcttggagtattcgatcagttagatgctcagctatttgggaaatacctacctttaaattacccctctgaa

SEQ ID NO: 256 - protein, 964 aa, Saccharomyces cerevisiae
MPEQAQQGEQSVKRRRVTRACDECRKKKVKCDGQQPCIHCTVYSYECTYKKPTKRTQNSGNSGVLTLGNVTTGPSSSTVVAAAASNPNKLLSNIKTERAILPGASTIPASNNPSKPRKYKTKSTRLQSKIDRYKQIFDEVFPQLPDIDNLDIPVFLQIFHNFKRDSQSFLDDTVKEYTLIVNDSSSPIQPVLSSNSKNSTPDEFLPNMKSDSNSASSNREQDSVDTYSNIPVGREIKIILPPKAIALQFVKSTWEHCCVLLRFYHRPSFIRQLDELYETDPNNYTSKQMQFLPLCYAAIAVGALFSKSIVSNDSSREKFLQDEGYKYFIAARKLIDITNARDLNSIQAILMLIIFLQCSARLSTCYTYIGVAMRSALRAGFHRKLSPNSGFSPIEIEMRKRLFYTIYKLDVYINAMLGLPRSISPDDFDQTLPLDLSDENITEVAYLPENQHSVLSSTGISNEHTKLFLILNEIISELYPIKKTSNIISHETVTSLELKLRNWLDSLPKELIPNAENIDPEYERANRLLHLSFLHVQIILYRPFIHYLSRNMNAENVDPLCYRRARNSIAVARTVIKLAKEMVSNNLLTGSYWYACYTIFYSVAGLLFYIHEAQLPDKDSAREYYDILKDAETGRSVLIQLKDSSMAASRTYNLLNQIFEKLNSKTIQLTALHSSPSNESAFLVTNNSSALKPHLGDSLQPPVFFSSQDTKNSFSLAKSEESTNDYAMANYLNNTPISENPLNEAQQQDQVSQGTTNMSNERDPNNFLSIDIRLDNNGQSNILDATDDVFIRNDGDIPTNSAFDFSSSKSNASNNSNPDTINNNYNNVSGKNNNNNNITNNSNNNHNNNNNDNNNNNNNNNNNNNNNNNSGNSSNNNNNNNNNKNNNDFGIKIDNNSPSYEGFPQLQIPLSQDNLNIEDKEEMSPNIEIKNEQNMTDSNDILGVFDQLDAQLFGKYLPLNYPSE

SEQ ID NO: 257 - DNA, 1854 bp, Saccharomyces cerevisiae
atgaccaaaaaactaccttcagagttgaaacagacgagaaagtctatccagacagcttgtgaattctgtcataccaaacatatacagtgtgacgtagggaggccatgtcaaaactgtttaaaaagaaatattgggaagttttgcagagataagaaaaggaaatcaagaaaacgaattgagaagcatggaacacaaccatacttgaatttggggaagaggctggtaatacatgatgtgccgtcgaagacggtatccccctcaagcgtacatctgcagcgagattttctatcttcagatcaggaaaaaccaggcaaaacacctgcccacaatacgaatatccaatatacgtataatataaatgataactttcaaagcgctggatctattccacgtattacgaacttcaatacgaataaccgccagaccgtcttagaaaatacttctaataatatatcagcttcacaagcagtacatttaatgaatgaccccatcatacccaccgtacggaagagtactctcaatttaaagtcgcatttcctagagcaacataaagcaatgcagcagccgctggctaccaattgtttggttgctacttcaaacgttcctgtgcactctggaatggacgatagtaataagagtgacgatgatgtcgatgacgaaactaatattcactttgatagtatgtggtgcaatgacgaatacatgaaattaaaggatatagtagatatttcaacgccgtttttaccgaataactcccagatattttccctccaagaatcagaatatcccaatcctagcgcatctacacggggaaattcgtcattgcatttaacgaaccttttaaactcgacaaaaagcgtgaatgaccaaaaggactcctcgatcggccattccacttctactttcaatacatatgatgaagtagtgtctaggccctttatatctttagacatgctgcatttgaatcgtggagcaaacgctaatacacacccatcacataacgccaaactggaaagcgaatgtgacagttctagtcactccgatgcagatctggagaaacatgataccgatttcatatcaccttcaaagtttcgtgaattagtaaagactcctcaagacctatatgacaataaatgtttaataaaaccgcataattacaagctcgcatacaccaaactgctaactactttaagaaaaaaatttcttgaaggagctgaaattgataaatctgcctcagtaaaagacgaacacagtacccaaaagcataatttgagatatgatttagaagttataatacgctctatactagaaagatatgctccaattttcatttcgttaacatccaatatgattgaagaggatttgctattacaggaagttaccttgcaaagggctttattagatttggagaacatggcaaaattagtaagctgcacaccgatgtgcatctggagaagatcaggcgagatttgttttgtcagtaacgaattctattctttaacaggttttaacaaaaatttactattagaccgcacctcctttatttttgaatatctggatcataaaagcgtttcgaattactttcaaatatttaacgaattgctggcatttggttacaatgatatcaataaaaggaaaaaactattgatgttgaacgcatgttcttctacctcgtcaaaaattacagaagggttttcttttactacggatggaaaagcaatctttactaagtgcaatttattattaagtaacggtctttatttgaagtgtgcctgttgttggacagtaaaaagggactcgtttaatatcccaattctcgtaatgggacaatttttaccaatttttgaaatggac

SEQ ID NO: 258 - protein, 618 aa, Saccharomyces cerevisiae
MTKKLPSELKQTRKSIQTACEFCHTKHIQCDVGRPCQNCLKRNIGKFCRDKKRKSRKRIEKHGTQPYLNLGKRLVIHDVPSKTVSPSSVHLQRDFLSSDQEKPGKTPAHNTNIQYTYNINDNFQSAGSIPRITNFNTNNRQTVLENTSNNISASQAVHLMNDPIIPTVRKSTLNLKSHFLEQHKAMQQPLATNCLVATSNVPVHSGMDDSNKSDDDVDDETNIHFDSMWCNDEYMKLKDIVDISTPFLPNNSQIFSLQESEYPNPSASTRGNSSLHLTNLLNSTKSVNDQKDSSIGHSTSTFNTYDEVVSRPFISLDMLHLNRGANANTHPSHNAKLESECDSSSHSDADLEKHDTDFISPSKFRELVKTPQDLYDNKCLIKPHNYKLAYTKLLTTLRKKFLEGAEIDKSASVKDEHSTQKHNLRYDLEVIIRSILERYAPIFISLTSNMIEEDLLLQEVTLQRALLDLENMAKLVSCTPMCIWRRSGEICFVSNEFYSLTGFNKNLLLDRTSFIFEYLDHKSVSNYFQIFNELLAFGYNDINKRKKLLMLNACSSTSSKITEGFSFTTDGKAIFTKCNLLLSNGLYLKCACCWTVKRDSFNIPILVMGQFLPIFEMD

SEQ ID NO: 259 - DNA, 2274 bp, Saccharomyces cerevisiae
atgacgccgaaagaatctggaaagcctatttcgtgtgcaatgaagaagttgaaaggcaagagatctaagattttggttttatctagagatgcgggcaccaacgaattgaagccaacgaaaggaagagcacatcgagcttgcatagcttgcagaaagaggaaagtacgatgtagtggtaatataccatgtagactttgccagactaatagttacgaatgcaaatatgatcgccccccacggaactcatcggtatttgatagggaagtaagcgatgatagttccttatatgcacagagagcttcccacgaacgggaagatagcaagggccctataagttccattgattacaaaaaggttgtagagacgatctttccacctgaaacactccgtcaaatacttgcttcttcttcttttaacagccagaattttttggacactattaaaacgtgtctacttcaaggacaattaaatgttaatcaggtaatacgtcaaagtctaccaaaagatacgccttggcacatgcaaacaagtgttccattaccacccagagagattgccttgaaatttattcaaaagacctgggattgtgcctgtgtgctatttaggttctatcacagacctactatcatttctatcttggactcgatatacgaagcagaaaaacatggcaagcaatatactccagaacaagtgaaaacacaacctttaatttattctgttttagcagtcggagcccttttttctaaggaagatctcagcaaggatagtaaagcaactagggaattttacactgatgaaggctacagatactttttagaggccaaaaactctttggacttttctaatattactgacatctattccattcaagctatatttatgatgacgatctttttgcaatgttcagcaaacttgaaggcttgctattcgttcattggtatcgctctgcgtgctgcgttaaaggaaggtttacacaggcggtcttccatagttggtcctactccgattcaggatgagacaaaaaaaaggctcttttggtctgtgtacaaactagatctgtacatgaattgtattcttggttttccaagcggtatcgacgaatctgatatcgaccaagagtttcctctagacgtcgacgatgaaaatatatctactattggaataaagtttcaagattggcgaacgataagttcctgtggaatgaataataagcatacaaagcttattttaatcatgtctcggatctacaagctaatgtactctttgagaagaaaaccattagaagaggattctaggacgcagattgtatcgttgaacgatcaattagataattggtatgcccaattaccagatattttgaaggttgacacaatacggtatcgtcaaacgcaaccacctctaactgtttccgcaaatgatactagttctccatacactaaacctaagaaattattatatctggacttccttctatccaaaatcgtactctataaaccattctaccactatatttctatagacccgttagatatcccagagttccaatttcaaattcacatggcggaaaactgtattgaagttgccaaaaaagttattcaattatcttatgaaatgattacgcaaaaccttttgagtggtagctactggttttccattcatacaatcttttttagtgttgcttgcctcaaattttatgtctaccaaacagaaaagggcctgatacgaaatgggaaggttgattcggatattcataacgctacgcagcttggcagtgaaatattatcacttttgaagggtgcttcaaatgcgagtaaacgtacttttgaagtattgaaccaattgttcaaagagtttaacgagaagacctctgtattatctgaacaacttttgaatatagttaaattgcaacggcaagaaagtagtggagctttagtgccccagttgcagacaaataataattttacgaagtgccaaggagaattacatcatggacagcagcatcaccaaactccagccacgagtcttcgttccattctgaatcttccacaaggggaagctgatctaaagtttcagaataccaataatgagagccatacaacgacagctgcacaagaagaatacttagataaacttctagcagaatttgaggaatttgactactcaattaacagagtattacctgatgtcatcgatttttcagcactaattggccaagattcttctgccaacaatcaaatattttcctcagaattcagctctgacccaacagtaaat

SEQ ID NO: 260 - protein, 758 aa, Saccharomyces cerevisiae
MTPKESGKPISCAMKKLKGKRSKILVLSRDAGTNELKPTKGRAHRACIACRKRKVRCSGNIPCRLCQTNSYECKYDRPPRNSSVFDREVSDDSSLYAQRASHEREDSKGPISSIDYKKVVETIFPPETLRQILASSSFNSQNFLDTIKTCLLQGQLNVNQVIRQSLPKDTPWHMQTSVPLPPREIALKFIQKTWDCACVLFRFYHRPTIISILDSIYEAEKHGKQYTPEQVKTQPLIYSVLAVGALFSKEDLSKDSKATREFYTDEGYRYFLEAKNSLDFSNITDIYSIQAIFMMTIFLQCSANLKACYSFIGIALRAALKEGLHRRSSIVGPTPIQDETKKRLFWSVYKLDLYMNCILGFPSGIDESDIDQEFPLDVDDENISTIGIKFQDWRTISSCGMNNKHTKLILIMSRIYKLMYSLRRKPLEEDSRTQIVSLNDQLDNWYAQLPDILKVDTIRYRQTQPPLTVSANDTSSPYTKPKKLLYLDFLLSKIVLYKPFYHYISIDPLDIPEFQFQIHMAENCIEVAKKVIQLSYEMITQNLLSGSYWFSIHTIFFSVACLKFYVYQTEKGLIRNGKVDSDIHNATQLGSEILSLLKGASNASKRTFEVLNQLFKEFNEKTSVLSEQLLNIVKLQRQESSGALVPQLQTNNNFTKCQGELHHGQQHHQTPATSLRSILNLPQGEADLKFQNTNNESHTTTAAQEEYLDKLLAEFEEFDYSINRVLPDVIDFSALIGQDSSANNQIFSSEFSSDPTVN

SEQ ID NO: 261 - DNA, 2115 bp, Saccharomyces cerevisiae
atgaagaatacggaacttagtcaaaaaaaaaaattagataggcagagtagaagaaagcctgcaaagtcgtgccacttttgtagagtaagaaagctcaagtgcgatcgagtaagaccgttctgtggaagttgctcttctcgaaatcgaaagcaatgtgaatataaagaaaacacttccgccatggaggaccaactcaggaaaaaatacaggagatgttcaaaattagagatggctcgtcgtattgaagagcttgaatctcagctaacaaaacaatcccagcctaacattcacgaaggacaaaaccctctttccaacatgagatatttatcttcaaagcacaataggcacattctttatggaccaacgtcgtatcgagcaatattagcaactcaaacagatacttttgccaaatacagagaggagatatggcaagtcctaaaactcagccgtaacaactggaaaagagagcatcattactcaacactctcggagattagttccattgagactgccccaccgcactcaggctcaccaagtgttattgaatacttatgtgaatcgcttccaaattatgaagttttgtgtgagtatttaactgatttttttgctagcgatttttacgatagttaccaaattgttcataaagaaaaagtattaagggatctgcaagattgttttgttaaaggcccaagaagtcataaaactggtcagcacacaataatttcccttaatctggacagtaaaaaaaattattataaagtgggtgttatgacagccattatgtgcttagcatcccatccaaaagaagtgccagaggctattgaagtcttccataaagttttaacgtcttttgtttcggctaaagttttttatactgagcgtgtgcaatttttatttttacgttacctgtacataaatgtggcgggtcttgacgggggcgatcagtcacattgcatatttattcatggtctgacaattgacacagctatccatatgggccttaatgaagatcttcgtcgtttatatctgagtaaaaatcatccaatagaggaaataccttacttggagagattgtggttatggatcctattcacggacgttaaaatttcactctctacaggaattccggtccgaatcaacgacgattttgtaaacaaggtacgtctagaaaactattcttcatcaggggacatccttctgtataaaacaacattaagactgagaaatattatgaaacaaattcatgctcgtgagaaaccgcctgacattccactcatcatcgaggacttaaaaaagttcaccattaaaatgtttaagccgttggatttttacttaaatgcatctaatttaaatggtaatgagttcaccgaacttcaattatggcatgcaactctccatatgataggaagtttatccaatctttataccttaacacatcaagattttgatgcgagaatattcaattttagcgtcctggctccactaaattcattacatttgtgctttaatgtccttgagacctattttgaattagacaacagcaaattatcttctaagtcattatgcctctccaaaaaatggccccatttaaacaatgcgttgtttcttatttatgtgaacgctttcagagcattaattcaaatttataccatttttctacagtatatggaaaataaagatatccaattattcattcagagaaattcgtccgcactaacttattctatatgtcctggagactttgagggtccacacaataagtgtatttcactgaaaattgcatttaaagaaatggaaaacatatttgatcatattcaccaagaaaagttgaaacctcttactcaaatttggcaaaactcctattacttttctattattatatcaatggaaaaaataggaagaagagcttttaacaaaggaatgaaaaatatcgatgaagggcctgaaaccgaaaatgatgcaactgaaaacagtttaacaactatactaaatgatttagagggacctttagaagatttctcggaaaatttcatcgatgatatattaggttctccaagtgccttctttgatacagctatttccgggtggagtaattttgaggacttcttttccaga

SEQ ID NO: 262 - protein, 705 aa, Saccharomyces cerevisiae
MKNTELSQKKKLDRQSRRKPAKSCHFCRVRKLKCDRVRPFCGSCSSRNRKQCEYKENTSAMEDQLRKKYRRCSKLEMARRIEELESQLTKQSQPNIHEGQNPLSNMRYLSSKHNRHILYGPTSYRAILATQTDTFAKYREEIWQVLKLSRNNWKREHHYSTLSEISSIETAPPHSGSPSVIEYLCESLPNYEVLCEYLTDFFASDFYDSYQIVHKEKVLRDLQDCFVKGPRSHKTGQHTIISLNLDSKKNYYKVGVMTAIMCLASHPKEVPEAIEVFHKVLTSFVSAKVFYTERVQFLFLRYLYINVAGLDGGDQSHCIFIHGLTIDTAIHMGLNEDLRRLYLSKNHPIEEIPYLERLWLWILFTDVKISLSTGIPVRINDDFVNKVRLENYSSSGDILLYKTTLRLRNIMKQIHAREKPPDIPLIIEDLKKFTIKMFKPLDFYLNASNLNGNEFTELQLWHATLHMIGSLSNLYTLTHQDFDARIFNFSVLAPLNSLHLCFNVLETYFELDNSKLSSKSLCLSKKWPHLNNALFLIYVNAFRALIQIYTIFLQYMENKDIQLFIQRNSSALTYSICPGDFEGPHNKCISLKIAFKEMENIFDHIHQEKLKPLTQIWQNSYYFSIIISMEKIGRRAFNKGMKNIDEGPETENDATENSLTTILNDLEGPLEDFSENFIDDILGSPSAFFDTAISGWSNFEDFFSR

SEQ ID NO: 263 - DNA, 2589 bp, Saccharomyces cerevisiae
atgggatatgactcccaagttaggacaaaaaaacgacatcgaattactgtagtatgcacaaattgcaaaaaaaggaaaagtaagtgcgatcgaacgaaaccatgtggaacatgtgtacgactgggagatgtggacagctgtgtctatctcaccgatagctctggacaacctgaaagcagtccttcattgaatgatgctgaccctctgaggaaacaatcaactcctgcggaacgaataagtccaggtttcattaagaaaagaagatcgtcacagacaagacaagacgaagatcactggcaaagagtacgagaacttgaaaatcaatcatcactttattatctaccaattcatgaagaaactccattttttattgacctcatccctaatgggttttatttagagaccaaaaggtctgctgataatttatttggtctgttcacggatagagcaattgaaaatcgcgacccctatctccaagcaatggtaacatttagaagtatcgcaatcaaaaaaatgatggataaattgggaagcaacggcaataatgtgaaaaatggaagcttgcctaaatctttcgaagctttatccactttcgatgctgatgacgaacgccacattagcgatgatgttgttggtaagggcaataacttccgcatgcatcagactattcacaaatcattgtttaacaaattcgctcaatacagagaaaataatgctaaaaaattcagctcagaaactatattagcaaaggattatttgcctcctttaaaaatacttgaaagtgaggttttagcactttttgaagaaaaaatttacaatatgataccgattttcgatatgaaagttttgcgtcatgaaataacgatattttatcaaaatatagtcgagaaagggaatccaatttctataaaacactacgatcatatggttttctgcataatcttgttgattattaaaatatgccgactttctgtccagttttcgaagctaactccatatatatacccggttcttcaagaaattgatacctctaagtttttggctcttgttaaacactatttgttcgagacgaaggtcctcagaaaatgtaatttattacagttgcaatgtctcatattactaaggttcttgcactggtgtgcccctgaagatggcgatggacccgaaactcaatattgtcaaatcttaatggggacaataatatcatcatgtaaagaaatgggcattaactggtattgcttctctcatccagaaaaatattcatttaaaataaaccgacatacgaggccttcatacgatataatgaaacctagcgattacatttcagttttcagaaagatatggagttatgttttattttgggacaggaagatgtgttttattagcggtgaagaatgtcaaattgggaaaaccttgcagtgccatttcaaagaagaagcagatacacccacatggtatatacgaatgttaaccctggataacttgatgaaaaagataaacgatacgttgaacgatgatccaggaaaggtagatttgaacttgttgcaccgactaataaatgatttaaaaagaaactttcatattttaaaaagcctgtcgaaaaacgaaaaagaaacaatgcgtcattttgatttcgaaatggaatggataatagatttattctcactaagtttgctgcacggagaaatgatcttttatgaatatgactgcaatattacaaaattttataagagtttccaagatttgtgggatatggtcattcatatctcagagaagtgctacaattacttttttaacagtgatgccttagaggtggattcattgacaaagttttataccaatagaatcgtggaaattgtcgcaaacaaagttttggtcattgttccggcattcattctcagaggagaccgcttcaaaacaattcagtacgccgacaagaagaaaatgatagaatttctttacggggtctcgtctgtgtattttaacgaatttggctttgagtactatcgttgttttagaaaaatgttcaccgctaaaattgcctacaagatcttgaatcgctcatgtgaaaaagatgcatggagaattattttaaaatttttgctgaatgaattgaaactagaagataacggtgatagttatatagattacaacgatatgagattaaatgacatctgtccaataatactagaatttcaggagacagtacaaaaatatgatgggtataggccagatattctaagtatatggaacaatgagttttatcccataggtaaatacaacgatgatatgacaggatttaagtttcaaatgcgcataaaggaaatgcaagaattcttggatatggagaaatattccgacaggtttaatattttttcatccttttatgatcacgccagttcacaattagctaaacatactgaagttgataccaacataagcattacgaatgaacaagtagctgaaattccgcaaaaagaactactacaacaacctttagcacccgctttgcctgttaatgatttaattgtctcagagtttgacgtgattgaagatatttttgatcctgtggatttcgtatcatttttt

SEQ ID NO: 264 - protein, 863 aa, Saccharomyces cerevisiae
MGYDSQVRTKKRHRITVVCTNCKKRKSKCDRTKPCGTCVRLGDVDSCVYLTDSSGQPESSPSLNDADPLRKQSTPAERISPGFIKKRRSSQTRQDEDHWQRVRELENQSSLYYLPIHEETPFFIDLIPNGFYLETKRSADNLFGLFTDRAIENRDPYLQAMVTFRSIAIKKMMDKLGSNGNNVKNGSLPKSFEALSTFDADDERHISDDVVGKGNNFRMHQTIHKSLFNKFAQYRENNAKKFSSETILAKDYLPPLKILESEVLALFEEKIYNMIPIFDMKVLRHEITIFYQNIVEKGNPISIKHYDHMVFCIILLIIKICRLSVQFSKLTPYIYPVLQEIDTSKFLALVKHYLFETKVLRKCNLLQLQCLILLRFLHWCAPEDGDGPETQYCQILMGTIISSCKEMGINWYCFSHPEKYSFKINRHTRPSYDIMKPSDYISVFRKIWSYVLFWDRKMCFISGEECQIGKTLQCHFKEEADTPTWYIRMLTLDNLMKKINDTLNDDPGKVDLNLLHRLINDLKRNFHILKSLSKNEKETMRHFDFEMEWIIDLFSLSLLHGEMIFYEYDCNITKFYKSFQDLWDMVIHISEKCYNYFFNSDALEVDSLTKFYTNRIVEIVANKVLVIVPAFILRGDRFKTIQYADKKKMIEFLYGVSSVYFNEFGFEYYRCFRKMFTAKIAYKILNRSCEKDAWRIILKFLLNELKLEDNGDSYIDYNDMRLNDICPIILEFQETVQKYDGYRPDILSIWNNEFYPIGKYNDDMTGFKFQMRIKEMQEFLDMEKYSDRFNIFSSFYDHASSQLAKHTEVDTNISITNEQVAEIPQKELLQQPLAPALPVNDLIVSEFDVIEDIFDPVDFVSFF

SEQ ID NO: 265 - DNA, 2307 bp, Saccharomyces cerevisiae
atgagcattgcatctcagaaaaaggttaagccatcgtttgtttgcttgcggtgtaagcaaaggaaaatcaaatgtgataaactttggcctacttgctccaaatgcaaggcctcatcctcgatttgtagctacgaagtggaaccaggacggattaacaaatctcccactatcgaaaatgccccacatagagacattagaaacattactcctgcatcgatgtccgcaagtggttcctttacttccatacttaatccaagtactaaagactgggaaatgaaaaattttgccatgaatttatcgaatgcacacgacaagcttgttgtaatgaataacacaaccatcgttgatagtccttttgccttccatagcattcttcaacatgatttgtatgcgaaggccttgaccacctgcatacatgagaggatactgattgatgtcgaacgccatcgtgaaaacgtttctgccaacaataaaaaaagagaacttaacttaacaatcggtgatattggacctttgttttttattgataaagctgcacttaaatttattgaaaatacctcaaaaacaagcaaattgtatcctccaatagattttctgtataacacgtatgattatgaacaagcgcatcctgaagaaaataatgataaaatttccataaacatccttttggaagagttatccaaatatttcctcaataagaatgaggttgatggcttaatcgtggacttttacaaaacaatatatccggtctatccgttactggaaatatcattattcgaagataacataagggagctgttgcaattgaatgaatttaatgggtataacattgtatttgcgggcaaagactctagaagaaaactggagacaataacactgctaactatcatattggctttttcttacagacgtttgagtctaagtactagtcattcatttaaagaatcttttggtgtaaaatcgaataatttaacgctactcgctcataaacttcttgctctcatgaacgtttttcaatatgttaatgaacatacactttgttgtctgctctattttttcatattgcggtatttgaatccagatcaagctgacatgtatcctactcacagtgacatactaaacctaaaatttttggagaatgtagcaataaagctaggactgaatgaagaacccttccaatacactcgatacgtcagcgaatcggacgattatccaagattattcaatttaagaaggaaattatggcttggcgtgcaatttttgaagtttggaatattgattccagaaggagattctgacattctaagtttggaatatttaagatcctttatgaaaactgacgaatctctaccagaactatttgagagaaattacgcttctactaataatctagacttatcgttgatggctacagcagagaatatctatcatttacatttatctttacaggtattactgacttcttgttttccaataaatggcccttcctacttgaaggaagtattggataacatcgacaagacaaaagattttttaaatcagaaattccctctcattttaagttctcttggagaaccaaggatgaagagcttacatatcaatgttccctcttccttagcaaatgaagaatcttttgactttagcacttttgaggaaaatgaaacattcatagctaatgtgattagctacacttgtacaatgaacatctatgatagcttatctttgcattttgaaaatcaatgtttcaaaaacgctttggagtacaaaacatattatcaccgctttacttttaccgctatacaagattatttaacgttgctaaaattaatctcggaatactttaatggatctcttctgcatttacgggaaccttttgggtttgccactcagaaagttgttcgcttttcgatacatcgattactcatattccaggccaccttgctcgtgagattattttataagaaggatacatgcgacagatcctctgcagccatgggaatgttgaatgatagaaacggaagacttagtcgagtcattgaaaaaatgatcaagttgatgtcatatcatatgaaattacttgtagaaattgttatctcgaaactggaaaagagttatctcggttcgttcatttctgtctctattttcaggtatatcatttatttggtggatactgacgcgctgtctgcgtttatatccgactactggaagagtgacgccgttatggatgaaagatattcaagaatccataggattgtcggtttaaaatggggtatgggaagggataagtccttttcgttcacacaaaat

SEQ ID NO: 266 - protein, 769 aa, Saccharomyces cerevisiae
MSIASQKKVKPSFVCLRCKQRKIKCDKLWPTCSKCKASSSICSYEVEPGRINKSPTIENAPHRDIRNITPASMSASGSFTSILNPSTKDWEMKNFAMNLSNAHDKLVVMNNTTIVDSPFAFHSILQHDLYAKALTTCIHERILIDVERHRENVSANNKKRELNLTIGDIGPLFFIDKAALKFIENTSKTSKLYPPIDFLYNTYDYEQAHPEENNDKISINILLEELSKYFLNKNEVDGLIVDFYKTIYPVYPLLEISLFEDNIRELLQLNEFNGYNIVFAGKDSRRKLETITLLTIILAFSYRRLSLSTSHSFKESFGVKSNNLTLLAHKLLALMNVFQYVNEHTLCCLLYFFILRYLNPDQADMYPTHSDILNLKFLENVAIKLGLNEEPFQYTRYVSESDDYPRLFNLRRKLWLGVQFLKFGILIPEGDSDILSLEYLRSFMKTDESLPELFERNYASTNNLDLSLMATAENIYHLHLSLQVLLTSCFPINGPSYLKEVLDNIDKTKDFLNQKFPLILSSLGEPRMKSLHINVPSSLANEESFDFSTFEENETFIANVISYTCTMNIYDSLSLHFENQCFKNALEYKTYYHRFTFTAIQDYLTLLKLISEYFNGSLLHLREPFGFATQKVVRFSIHRLLIFQATLLVRLFYKKDTCDRSSAAMGMLNDRNGRLSRVIEKMIKLMSYHMKLLVEIVISKLEKSYLGSFISVSIFRYIIYLVDTDALSAFISDYWKSDAVMDERYSRIHRIVGLKWGMGRDKSFSFTQN

SEQ ID NO: 267 - DNA, 2103 bp, Saccharomyces cerevisiae
atggatggatcccattttcctatgaaatctactaccggagagcccgtttcaagtggtaagaagggcaagaggaggaaggtcatcaagtcatgtgcattttgtagaaaaagaaaactgaaatgcagtcaggccaggcctatgtgtcagcaatgtgtaattagaaaactaccgcaatgcgtttacacagaagagttcaactatcccttgtctaatacggaactgttcgagcaagtgcccaatgtagcgttggttcagaagattgagaatttgcagactctactgaaggaaaacgataacaataatgcgaaaccggtgtattgcaggagttcagaaaatccattacggtcactgagaacttcggttttaggtgataatggctcgaggtatgtgtttggccccacttcctggaaaactttatctttgtttgaacaaaataagtttcaaactgagtttcaaaatttatggaaagtcttgaaaccacttcctgaatgcactaaatcgcaattaaatgaaaatgatgttgtagcagatttgcctagttttcctcaaatggaaagctgtattaaatctttttttgctggaccgctgttcggcatattgcatatcttcaaccaagacgatattctgtccctcttggacagactttttattagagataccacggacaagaacctagtcatcctcctcgatttgcaaggtaatgcaaaagataagtataatcttggcattgtacttcaaattctttgcttgggctattataaccaagatatcccttcttccgtgagtcatttccttcacactttaagtgcagcgtccttgtcatcatcgagctcaaatttcgtggaaaaactacaatttttcttattgtcctatattagtgtaatgataaattgcacggacggtgtatgggatgcgactcaaggcgttgacttaatcaacgagctatgccaggggtgcataagtttgggtttaaatgatattgataaatggtatttgaacgaaagtgaggaaaccaaacaaaacttgaggtgtatttggttttgggctttattccttgatgtatccacctcatatgatataggtaatcctccgtctatttcagatgatcttttggacttaagtatatttactgcgcagaatttccaatcaccgagtattgactttaggagagttaagctaatgcacgattttttagatgtttcccgattcactactcgtgaaattcacaagagagagatgaacgaaaaattgaccactttttcattgagattgattgaatttatacaatctaacttttcacctatcgaacattatacaaattcagtttactactctgatattgatccctttgatatattgattttatcaagatctctaagtatagttgctagtatatacaatattgagatgatcatcgctcaacaaagcagaatcatagataagaacagaatggttcagttcttgttgatatccatatcagtctgtgttaatacaatggtatttcattttaaagagcctatcaacgaccaggagaacgtgttaactgaagggctaaaactgtctattattctaatcaatccacttttaatacgaatagtatcgcaagtgtacagtttagcatttaataggttaatcttcagggagaaggcattccttttccttattgaccttgacactgggaaaaaaatacaattcattaaatatgaagaagaaaactttgatgaacttttgacaggattcgatgttaggactgataaatttctgtcattttcaggaacaataataagattttacgaaattattgatagcatatttgctgttaatgaaagaaataagcgattgttaaaagcagtttccaatttttatcagttaacttcaactttggcgtttgaacgcgtaagtagggttttattcgataaagcgtcccaagcaagaatagagactgaaaaaatttggctgaaaaagggcattaatatggagcacttcagtgatctcatgattgaagattttattaatgatgtttggaaaacgttcaaagagatttccaaagacctttggtccattgacaaaaagaaattttataaacaatatcatttcgattta

SEQ ID NO: 268 - protein, 701 aa, Saccharomyces cerevisiae
MDGSHFPMKSTTGEPVSSGKKGKRRKVIKSCAFCRKRKLKCSQARPMCQQCVIRKLPQCVYTEEFNYPLSNTELFEQVPNVALVQKIENLQTLLKENDNNNAKPVYCRSSENPLRSLRTSVLGDNGSRYVFGPTSWKTLSLFEQNKFQTEFQNLWKVLKPLPECTKSQLNENDVVADLPSFPQMESCIKSFFAGPLFGILHIFNQDDILSLLDRLFIRDTTDKNLVILLDLQGNAKDKYNLGIVLQILCLGYYNQDIPSSVSHFLHTLSAASLSSSSSNFVEKLQFFLLSYISVMINCTDGVWDATQGVDLINELCQGCISLGLNDIDKWYLNESEETKQNLRCIWFWALFLDVSTSYDIGNPPSISDDLLDLSIFTAQNFQSPSIDFRRVKLMHDFLDVSRFTTREIHKREMNEKLTTFSLRLIEFIQSNFSPIEHYTNSVYYSDIDPFDILILSRSLSIVASIYNIEMIIAQQSRIIDKNRMVQFLLISISVCVNTMVFHFKEPINDQENVLTEGLKLSIILINPLLIRIVSQVYSLAFNRLIFREKAFLFLIDLDTGKKIQFIKYEEENFDELLTGFDVRTDKFLSFSGTIIRFYEIIDSIFAVNERNKRLLKAVSNFYQLTSTLAFERVSRVLFDKASQARIETEKIWLKKGINMEHFSDLMIEDFINDVWKTFKEISKDLWSIDKKKFYKQYHFDL

SEQ ID NO: 269 - DNA, 4023 bp, Saccharomyces cerevisiae
atgggccgtccaaggaagaatgttagccaggagaaaatacaacagttgaagagagaactggagctggccggtaacaggacagacgtcttgttgcaagacaaaaagggccgttccaggtcttgtcttctttgtagaagaagaaagcaacgatgcgaccataaattacccagttgtaccgcctgtttgaaagcaggaataaagtgcgtgcagccctccaagtactcttcttccacttcgaacagtaacaccaacaacaacacccctacagctggcactgtacctcctacacctcatcctgtaataaaacgtgagctgcaagatagcagtattggcgctggcgctggcgctgccacttctctgaatgacatgacgataataaaacccatttccactagcaatagtaatgttgatgctggcgacgcgaatgaattcaggaaaacgataaagtccgtcacgacaaattccaatccaaacctgatgaggcaagacaaagatcagtatacgattttcttggagaaaaaactaaaaagtttggagactttgctcgatttatcgccgggatgcaaccagtacaactacgaattatcccagtacaagaaggtttctcatttgttcagtaacaacacttctgattactctagaccgaacagcagcaatatggtcatactgccgctgccatctccttccaacaaacccctggagaacacaaacaataacggcagcaacgttaatgcggccactaacgatacatcggccagtacgaacaacataaacaacaataatgctatctgccaatccgcgagccttttgaatgaccctttagagacgctggacttcactaagtgtatttttgccaaatacaatttgaaaaaagagtttttgatgtatgaccctatttttgaactgaatgagaagctgtcacgttccttcttggacacttttttcacaagattacaattcaagtaccctatcttagacgaacaagaaatctatactttttatgaccactacctccacaacaagattcttatcccaccatcttctcccgccacgtcttccgcagcaccaccgtcgaattcacattcgtattctgaaatagaatttcattttctatccggcagaatgtggcttgtcttcagcatcagcgcctacttactgatgaccacaggtaagtacaaggggtttccacctcaccgatatttctccaccgctatccgtcacatcactaagtgtggtctacatttgaattatgttcagcaaatagaactgttgacattgcttgtcctttacattattaggactgatagagattctctgatactatatgacataatcaaggatgtcatgggcatatccaagaagaaacttcatctaaatcaatggtatcctaatgatccatttgcaaataagaaactgcgactattttggtgtgtttacctgttggaaagaatgatttgtgttgctgtggggaaaccttatacaatcaaggagtcggaaataaatttacctcttttcaataacgactctttttatacaaaaggtgtgcatgcggcggctccatcaaccaatgaccatggtgtgcaattcatcaatcagtctctaaagctgcgaagaattgaatctcaatttgtagagactttacagctattgaaaaacgattccaggtcagtgaagcaatccattgatcaattgcccctagtacgaaaattttttgaagatttggaagtttggagaaaaagttattccactcttgacgtgaaaaatttcgaaaacgagacactaaaactttattactatagatcagtgcgattgcttatacaaccatatttggaatttttcgccccggaggatagactatttagagaatgtcaagctgctgcgggtcaaatttgtcagttatacaagatattccatcaaaaaacgcttaatggtcattctacaccagcagtgcatacggtttttgtagctggcgtaactttaatctactgtatgtggttagccaggaattttgacgatcaaaggaggaagaaattaggcgatgcttcgaagcatactagacctttaatcagtgcaagtctcttttcgacgatggatgatttgagagcttgctccgtttgtttatatgttatgacagaaaggtctaattttgcaagaacctttagagatactttcgatcagttaatgaatgccacggtaggtaatttgattgaaagatgtggtccagactcttctgagttaattttcatggctagtagtgtcgccaagcgtactgaacccaagaacatcaatgatgaggccaataaggcaatttcatctggggatactcttcatgattctaactccgcaaatgcagctaatctatccaattcaaacgataaaaatatatctcataatggcggtatgccgcctgctgtggctagaatatttggtaaaggacaagctgaagagcacgccggttttgtggaaaattcacaagtggatttggctgaacaagagaaattcaagaagaagcaaggtgttttagaaaagacctctgtacccaaaagtttagctcacctattaaccaaaatggatgacaggtcacgtatttcaaattcttcaatgtcttatacaacatcttcttcgtcatcatcttcttcttcgtcatcatcgtcgacattatcgtttccttcttcccaagaaaaaaacctgaaaatcaatgtaaacaatgataacaatggtatgaccatcagcagcgtcaacagagaacacaacaataatcacaacaataataatgataataataataataataacaataataataataatagtaataataataataatgttaataataatgataatgaaagtaatagcagaagcactaccaacaacagctgcaataatggcaacaacagccagtatgttcgtaacaacaacgtaactatggaaaatgatgtagaaaggcctattcaagaccaatatatcgtcaagaaaccaaccaaccaaacagagtttgattggcaagtatttcaacagcaggcctttctacaacagcaactagctcagcacaatttacaagcgtatctatcgtccctgaacaccgatactatgaccaatagaagtccttcaaaatcttctagcatatctacagcctcttcgcattcggatccgattccaatagcgatgacgcaaagcccaactccatatcctcaaacttccaatatgctaccgcaacagcatgtatcacgaccactgccgcaacaacagcgggagcagccacaacaacatattacttctccacaaagattctcagaaagcaattttacgaatcaattaaacaatggtatgatcaacagtaatcctctacaatctgcaatattctctaaccatacaagtgaaaataagcaattaagagatgtcgaagaatcaaatttcagtacatcacccctaagagcagattatggcaataatattatctcctcgataccagcgtcatttactagcaattcaattccggtcagtgtcaaacaagctcgaaatggctcttcttcgggcgatatacttttcagcaacggtgctcatgacatgatcaacaatatttccacctggaccaataactccgttctagatgctttgaatagcaagtccatactacaaacaatatttccccagagtcaagagccttcatctctgtccatggacaaacagcagcaacaacatcaacaacaaaatatgtgttctgaaaacaatgtaaccgctaataattttcaacagacgcagaatgacccttcgtataacagaaatttgttcatgatgtccaatcaggaaggtgtacaatataatcttgacgaaacagagaagaatggacctaaaacacaggtggaagcaaacactagcgcaaatctgcatttcgacaatgttattcctacagtaactaacgcagacatcaggaaaaagcgttctaactgggataacatgatgacatctggtccggtagaagacttttggacgattaatgatgactacggctttttaacg

SEQ ID NO: 270 - protein, 1341 aa, Saccharomyces cerevisiae
MGRPRKNVSQEKIQQLKRELELAGNRTDVLLQDKKGRSRSCLLCRRRKQRCDHKLPSCTACLKAGIKCVQPSKYSSSTSNSNTNNNTPTAGTVPPTPHPVIKRELQDSSIGAGAGAATSLNDMTIIKPISTSNSNVDAGDANEFRKTIKSVTTNSNPNLMRQDKDQYTIFLEKKLKSLETLLDLSPGCNQYNYELSQYKKVSHLFSNNTSDYSRPNSSNMVILPLPSPSNKPLENTNNNGSNVNAATNDTSASTNNINNNNAICQSASLLNDPLETLDFTKCIFAKYNLKKEFLMYDPIFELNEKLSRSFLDTFFTRLQFKYPILDEQEIYTFYDHYLHNKILIPPSSPATSSAAPPSNSHSYSEIEFHFLSGRMWLVFSISAYLLMTTGKYKGFPPHRYFSTAIRHITKCGLHLNYVQQIELLTLLVLYIIRTDRDSLILYDIIKDVMGISKKKLHLNQWYPNDPFANKKLRLFWCVYLLERMICVAVGKPYTIKESEINLPLFNNDSFYTKGVHAAAPSTNDHGVQFINQSLKLRRIESQFVETLQLLKNDSRSVKQSIDQLPLVRKFFEDLEVWRKSYSTLDVKNFENETLKLYYYRSVRLLIQPYLEFFAPEDRLFRECQAAAGQICQLYKIFHQKTLNGHSTPAVHTVFVAGVTLIYCMWLARNFDDQRRKKLGDASKHTRPLISASLFSTMDDLRACSVCLYVMTERSNFARTFRDTFDQLMNATVGNLIERCGPDSSELIFMASSVAKRTEPKNINDEANKAISSGDTLHDSNSANAANLSNSNDKNISHNGGMPPAVARIFGKGQAEEHAGFVENSQVDLAEQEKFKKKQGVLEKTSVPKSLAHLLTKMDDRSRISNSSMSYTTSSSSSSSSSSSSSTLSFPSSQEKNLKINVNNDNNGMTISSVNREHNNNHNNNNDNNNNNNNNNNNSNNNNNVNNNDNESNSRSTTNNSCNNGNNSQYVRNNNVTMENDVERPIQDQYIVKKPTNQTEFDWQVFQQQAFLQQQLAQHNLQAYLSSLNTDTMTNRSPSKSSSISTASSHSDPIPIAMTQSPTPYPQTSNMLPQQHVSRPLPQQQREQPQQHITSPQRFSESNFTNQLNNGMINSNPLQSAIFSNHTSENKQLRDVEESNFSTSPLRADYGNNIISSIPASFTSNSIPVSVKQARNGSSSGDILFSNGAHDMINNISTWTNNSVLDALNSKSILQTIFPQSQEPSSLSMDKQQQQHQQQNMCSENNVTANNFQQTQNDPSYNRNLFMMSNQEGVQYNLDETEKNGPKTQVEANTSANLHFDNVIPTVTNADIRKKRSNWDNMMTSGPVEDFWTINDDYGFLT

SEQ ID NO: 271 - DNA, 2832 bp, Saccharomyces cerevisiae
atggacacgcagattgcaataactggcgttgccgtcgggaaagaaatcaataatgataattcaaagaccgaccaaaaagtttctttgccgaaggcggatgtcccatgcatagataaggccacacaaactattatagaaggatgctccaaagatgaccctaggctttcgtatcctacaaaactagagactactgaaaaggggaagaccaaaagaaactcatttgcttgtgtatgctgccattccttgaagcaaaaatgtgagccttctgatgttaacgatatttataggaaaccttgtcgaaggtgtctgaaacacaagaagctgtgcaagtttgatctttcaaaaaggacaaggaagagaaagcctagatcaaggtcacccacaccttttgaatcgccgatggtgaatgtctctactaaaagcaaaggcccaacagattctgaagaatctagcttgaaggatggtacatcttacctcgccagtttcccttctgacccaaacgctaaacaatttccaaactctcggacagtcttacctggacttcaacaaagtttatccgatctttggtcaactttaagccaaccaccctcatatggagcaagagaggccgaaaccacatctaccggagagataaccaccaataatcatacaaaatccaatggcagtgtgcccacaaatccagcagttttagcatctaacgatgagcatactaatattagtgatgcgccagttatatacagtacctacaactcccccgtaccgatttcatctgcgcctaccagcattaacagcgaggcactgttcaaacataggcctaaaattgtgggtgatgaggaaacacagaacgtcaaagtgaaaagacaaaagaaatcatactctagacatatgacacggtcgttcaggaagcagctacaatcactgattatttctcaaaaaggtaaaattagagatatttcgatgaagcttgacacttggtcaaagcagtggaatgaccttgttgaaaagagcatgtttttgccaaccattgcagatcctgtatcagtaggaatcatatctcatgaagaagcgacgcttcgcttacatctttataaaaccgagatttcatatttgtcaaaattaccattcataaaggtcgaagagaatgttagtgtcgatgaattaagaaagaagaaacctattttattctccgtcattatgtcatgtgtttcaattgtactaacacccaaacaaaccaccagaggaactattatgaagcttgatagttttgtactaaacttaattacaaatcagattttcaaggctaataataaatctatcgaaatcatcgaatcactgtctacattatgtctatggtataatttttttgaatggtcaagtaaaacgagataccatatatttaattacatctgttgctgtttaactagagatttggggcctacctatgtcaatcgatcctttggtatgtttagtgacgaggatccaaagagattcaagtcacctttggaactttacagtaatggcgccagtttaactttattggtatacatttccgcactcaatatttcaatttttctacgtcaatcaatacaagctcgttggagtcacgtcacggaaaaggcctgcgaggatttagttaaagagacgaaaaaatcgcgacattatgacaacgataaactattacttgattcagctgatgatcccatcttggttcaatttgctaaaatgaaccacgtcttggaaaatattcacacacacctacatgagagagatctaaatgatgacgagtttgatgatcctatttttactaaaaagtatcttaataaactaatggaaaaataccacaagcaattgcaagagattttcactaaacttgacagaaacaggccaagagtgattgcattttattactctgtagaagcttatttataccagtataaacttgcagtattcatcggggaaatgtcgcataccataaacgaaaaagtcgaattgcccagagaaataatggatgattttgttaaatgctatcattgctgtaaatctgcccttgaggaattttccaagttggagccaattttaattacctcattacctttatttcatacttccaggatcatatataccgttggtatgctcttattaaagctgcgctattccgtagtcgctattccttcgtttcacgatttaatgccccttacagatgatgctattgccttggtaataggggtaaacaatcttttagaaaaaacatcagagctgtatcccttcaacaactctctttacaaatttaggtatgttattgcgttattttgtcaaacctacgcaaacaaagttattgatgttgctgatcgctacaatgcagaaagggagaaactaaaggaaaagcaggtcatagacgaagtaagcaatggccacgatggtacgaagccaataaatgcatatgtaaccgagtcacaaaagatgccaacagaagaagatccaattatcgacaataatacaaaccaaaacataaccgctgtacctgatgaaatgctgccagtatactcaagagttcgtgacgatactgccgcaatgaacctgaatattaacagtacttcatatatgaatgaatccccacatgaacaccgagagagtatgacaggcacaactctattaccaccaccatttatttctaatgatgtgactaactctgctgactcaactaatataaaaccatcacctagttcatcggtagacaacttgaacgattatttgacggatataaactccttagcatggggcgttaattcattaaatgacgagttttggacagaccttttcatgaatgatatt

SEQ ID NO: 272 - protein, 944 aa, Saccharomyces cerevisiae
MDTQIAITGVAVGKEINNDNSKTDQKVSLPKADVPCIDKATQTIIEGCSKDDPRLSYPTKLETTEKGKTKRNSFACVCCHSLKQKCEPSDVNDIYRKPCRRCLKHKKLCKFDLSKRTRKRKPRSRSPTPFESPMVNVSTKSKGPTDSEESSLKDGTSYLASFPSDPNAKQFPNSRTVLPGLQQSLSDLWSTLSQPPSYGAREAETTSTGEITTNNHTKSNGSVPTNPAVLASNDEHTNISDAPVIYSTYNSPVPISSAPTSINSEALFKHRPKIVGDEETQNVKVKRQKKSYSRHMTRSFRKQLQSLIISQKGKIRDISMKLDTWSKQWNDLVEKSMFLPTIADPVSVGIISHEEATLRLHLYKTEISYLSKLPFIKVEENVSVDELRKKKPILFSVIMSCVSIVLTPKQTTRGTIMKLDSFVLNLITNQIFKANNKSIEIIESLSTLCLWYNFFEWSSKTRYHIFNYICCCLTRDLGPTYVNRSFGMFSDEDPKRFKSPLELYSNGASLTLLVYISALNISIFLRQSIQARWSHVTEKACEDLVKETKKSRHYDNDKLLLDSADDPILVQFAKMNHVLENIHTHLHERDLNDDEFDDPIFTKKYLNKLMEKYHKQLQEIFTKLDRNRPRVIAFYYSVEAYLYQYKLAVFIGEMSHTINEKVELPREIMDDFVKCYHCCKSALEEFSKLEPILITSLPLFHTSRIIYTVGMLLLKLRYSVVAIPSFHDLMPLTDDAIALVIGVNNLLEKTSELYPFNNSLYKFRYVIALFCQTYANKVIDVADRYNAEREKLKEKQVIDEVSNGHDGTKPINAYVTESQKMPTEEDPIIDNNTNQNITAVPDEMLPVYSRVRDDTAAMNLNINSTSYMNESPHEHRESMTGTTLLPPPFISNDVTNSADSTNIKPSPSSSVDNLNDYLTDINSLAWGVNSLNDEFWTDLFMNDI

SEQ ID NO: 273 - DNA, 1821 bp, Saccharomyces cerevisiae
atggacagatctaaggacgctagaaagagatctattagtttggcctgtactgtgtgtaggaaacgaaagttgaagtgcgatgggaacaagccatgtggaagatgtataaggctaaatacaccaaaagaatgcatttataatattgataaaaggaaagacaagagaaaaatcaaaaacgggtcgaaggtttttttattcaagaataatactatcgataacgggaataactctatactagagaacaaaggactaaatgaagacctttcttctcatatatatgagaaagaagcgccaaaattcgattcagatattgatatatcaagatttggcacaaatgatgctgtgatttttaataatgacgggtgggacacttctcttccgatcgattttgatttcgatgagtttaacactgagacaacagatttcgatgactttttaaaactattaggcgataattcaccttcaaaggaacaaaaaagtctttcctattcacctactgctacaggcttaagcggtgtggttaaagaaactgagagcgaagataacgctcctacgaggtctcggctaatcgatgtcttgtttgagaacaagcttcactccgtaccaggaatatcaaaatggcatctatatgagctggaatcccaatacccaaatttggaatgtacagaaggaaatagtgatgaaaagtttttactttcaactgtattgtgcctggggtcgttgaccatacgaaaaagggaactattgaatcattcgaacatagacaatcgtccacttttgccggagaatagtatttcaaaactgaccactgatgcttttaagtactataatgctgcgaaaacgcttgttcccgacttgttatctcatcccacaatcgatggattttgcggcctcgttctaatggcaaatttcatgacgatgatgatatccttagagcaccaattatatttgagtataaatgctttacaacttgctgtggctttaaacttgaacaacaatacaaaatgcaaggaattacttgagtcgaacagcgacggaattggtgtgatcttgcttttttggaacatttggtgttcttcttgcatgttggcaacaattcatggaaaaaatccttttatcactttggaacaaattacaacacctctgccgtgtgaaatatccccccgcaataaaactaataaacttttgatagatttcatgcaaatcagaatcaagctagccactctacaaagtaagatttttcaacggctatatacttccagcaccgcaaacgaggtaccattcgtaaacttagaaagagaatttgaggaggtttcactccagattaccaggttaaaaggctttccgatattcgaagaacatcttttttacaggagcagagtcttaatgttagagctatcatgtttaagagctcaagcttcttttctattatatcgtccgtatctgatcactggagaatccttacaagcagtaaccatggcaaaatcaataattcacgaaatatggagtcaatacactaaacagtttcccgataacgaaaaggaaaggcatgaacgtttggattggaatttttgttatcctttaagaacagcgtcactgacattatgtatttcatgtattatactcctaaggtataagcaggtggtgcagttccttaaaggtactgaactatttgaatacattctagcattggaaatattgcaagatttagttcaggtacttcctattgaacaaaaccttattgatataatcaaatatccgatcagtccagtacagctgagtggtgatagctttgtcgaattttggggtcgcatactttac

SEQ ID NO: 274 - protein, 607 aa, Saccharomyces cerevisiae
MDRSKDARKRSISLACTVCRKRKLKCDGNKPCGRCIRLNTPKECIYNIDKRKDKRKIKNGSKVFLFKNNTIDNGNNSILENKGLNEDLSSHIYEKEAPKFDSDIDISRFGTNDAVIFNNDGWDTSLPIDFDFDEFNTETTDFDDFLKLLGDNSPSKEQKSLSYSPTATGLSGVVKETESEDNAPTRSRLIDVLFENKLHSVPGISKWHLYELESQYPNLECTEGNSDEKFLLSTVLCLGSLTIRKRELLNHSNIDNRPLLPENSISKLTTDAFKYYNAAKTLVPDLLSHPTIDGFCGLVLMANFMTMMISLEHQLYLSINALQLAVALNLNNNTKCKELLESNSDGIGVILLFWNIWCSSCMLATIHGKNPFITLEQITTPLPCEISPRNKTNKLLIDFMQIRIKLATLQSKIFQRLYTSSTANEVPFVNLEREFEEVSLQITRLKGFPIFEEHLFYRSRVLMLELSCLRAQASFLLYRPYLITGESLQAVTMAKSIIHEIWSQYTKQFPDNEKERHERLDWNFCYPLRTASLTLCISCIILLRYKQVVQFLKGTELFEYILALEILQDLVQVLPIEQNLIDIIKYPISPVQLSGDSFVEFWGRILY

SEQ ID NO: 275 - DNA, 2358 bp, Saccharomyces cerevisiae
atgagtaagcggggtagtttacaggatagagcttccccatcggaggaaactgtaaagaaggcgcagaagagacggaaaccaataaagtcatgcgctttttgtaggaaaaggaaattacgttgcgaccagcagaagccaatgtgctcaacttgtaagacgaggggtcgttctggttgcctgtatacagagaaattcacccacaaaatagaaacaaaagagttatttggcagtactccgaacattgaactgttgaaaaggattgaggatttagagaaaagactagatgacaaagagttgacggagaaggatgtagcgcttagtacgagcccatttaggaacccttacgctaatttttactatttacaatgtaaaggctcgggaagaagaatagtatatggtcctacatctttgagaacgcatctctcaaacgatgataatcggtttgtaaacacgtataatcagctctggtccaaagtgaaaatcgagagaaacagatggaaggctaggcataaatggacaatgaagccagaaactcaactcctagagggaccgccgttagaaaagacaggctctgacatcttgcaacaggtttgtaacgttttgccatcttttgaacaatcgtcaaagattataacagactttttcaatactgaactggaaactaatgaagttagtgaagtattagataaaaccaaaataataaacgatttcacttcctcgtttcttccaagtgacgaactgttacccaacggtgaaaggcggattgaaaagttattaccatcgacaaagaaaaactattataagattggagttattttgatgatactgtgtattcgccatttctacaaaaatactccggaagagatagagaaatttctcatcatgctgacgggactgtcaacagctaaagtatatttcattgaacgcgctcaatttctcttattgaaatactatcatcgagaactaatttgggcgtgtggagacgattcgcatatgattagtctagttgacttattatgcagcacggcaattatgctgggtttacacttgaatataagagaaatatacaaaaatcaagaaaatattgtggggagtatggaaagtttggaaaatttgtgggtttggattatattatcagatttcaatgtttctttaaatattgggagatgtttggcgattaactcatcctattttcaagtcgatgaatgcgagaatggtgagaggttgcctaaaaatacaaacaattattcatcgacggtttttttcgatcagtcaaattcctgcatgggcaagcttaaaaggtttttaagattagctcgaccaatgctagatcaaatttatgatagaagcgcatttccagacttagccgaaaattgtaaaaaactaagaaactttgtagagactgaattccacccaatatcatattacactgacagtgagttaatatctaaagttcctttgtgcgagattaaagtgcttgcgcaggttttgaatttgttgttgacgttttattccttgaggtatttgatttacaaggaaaaaagcgttgttttagagaacaacatcctgcaaaccattttggtctctttttcccttgtcatcaatacgaccatactgtgttttaacctagatgagaagcattttcctgagttttttgatcataattgcgttcatttaccgccatttatggccttgtctttagtatacacaaatttcctttttcctagggcctctactggcttttgtgcgtttttgtatcataagttaactctttttgagaagggctattatctatcatccaacatcaaagatcaagaagtcacagattgggatttgtcaaccttgaatatcccgttggataaagctatgaacttacttactgctttcaaaatacattcagatatatttgctaaatggtctaatgataacaacaagcagttaagaattattatggctcgctcttatacatttgttatcaacatcgccctggaaagcatatatagagctgttttggaaaaagtaatcaaatatagaaccgaggtcgaaaacacatggttacaacaactccaagacgaattgaatgggtcctattcgctcactgacaatgtaaatactccaatcgatcccagtttaagtgacctgggcgtcacaagcgccagtccattggcgggaaattctccaggattacccccggaggaagtgcgaaataacagcgaaaacgcttcgcataacaatgaaactgggccaattgagactgaactggcacagacaatatccaacgaattttggacggcgtacaaccttggctgggaggaactaatgagtcagccagattataaatatttatttgatacgcag

SEQ ID NO: 276 - protein, 786 aa, Saccharomyces cerevisiae
MSKRGSLQDRASPSEETVKKAQKRRKPIKSCAFCRKRKLRCDQQKPMCSTCKTRGRSGCLYTEKFTHKIETKELFGSTPNIELLKRIEDLEKRLDDKELTEKDVALSTSPFRNPYANFYYLQCKGSGRRIVYGPTSLRTHLSNDDNRFVNTYNQLWSKVKIERNRWKARHKWTMKPETQLLEGPPLEKTGSDILQQVCNVLPSFEQSSKIITDFFNTELETNEVSEVLDKTKIINDFTSSFLPSDELLPNGERRIEKLLPSTKKNYYKIGVILMILCIRHFYKNTPEEIEKFLIMLTGLSTAKVYFIERAQFLLLKYYHRELIWACGDDSHMISLVDLLCSTAIMLGLHLNIREIYKNQENIVGSMESLENLWVWIILSDFNVSLNIGRCLAINSSYFQVDECENGERLPKNTNNYSSTVFFDQSNSCMGKLKRFLRLARPMLDQIYDRSAFPDLAENCKKLRNFVETEFHPISYYTDSELISKVPLCEIKVLAQVLNLLLTFYSLRYLIYKEKSVVLENNILQTILVSFSLVINTTILCFNLDEKHFPEFFDHNCVHLPPFMALSLVYTNFLFPRASTGFCAFLYHKLTLFEKGYYLSSNIKDQEVTDWDLSTLNIPLDKAMNLLTAFKIHSDIFAKWSNDNNKQLRIIMARSYTFVINIALESIYRAVLEKVIKYRTEVENTWLQQLQDELNGSYSLTDNVNTPIDPSLSDLGVTSASPLAGNSPGLPPEEVRNNSENASHNNETGPIETELAQTISNEFWTAYNLGWEELMSQPDYKYLFDTQ

SEQ ID NO: 277 - DNA, 1638 bp, Saccharomyces cerevisiae
atggcatccccaggatcgacagcattaccacacaagcgacaaagagtccgaaaggcttgcgtgccctgtagggaacgtaaaaggaaatgtaatggcaaatctccatgtgaaatgtgcgttgcctatggatatgtatgtcattatattgacggtcgtgtcccttcggcatcacctcaagtgcaacaagtaggtgaaacatctcctgatacggagagcagaccttttgttcttccgggtatacatagaaacgaacaaccgcagcctataaatacacagaacgttacaagtcaaaacattgtagatccaactaagtctaggtacacgatccagcactctgcagttgctttcccccgctgtcttggtctcgaactccgatcaactaatcctccacgcctacattccttcgcttggcattgcggaatcagaccggaagaaaatccaaactcacatgtccttctttctgatttagttacaaaggaagagtattaccgtatctcaaaagtttatttttcagttgttcacccgatatttgatgttgttaatccagagcaactggcaaagaatgttgaaaaatactgggatggcgacgtaaaaaccttagagtatggggctgttattgcaggggtgatagctttaggatcattttttatgggaagtcttggccatccccgagagatggatatagtacaatatgccaaagggatccttgatgacccgactttcagtcgcattcccacggtggagcaagtctccgcatgggttttgcgcaccatttacctgcgagccacttcgaggccccatgtagcatggttagctagctgcgtaaccatccatctttctgaggcaattggcctgcatcatgagattgacagagaggatatagcgatatcgaacaacgttccaccaaaaagaactactgtagtgagcgaacacactagaagattattttggtgtgcatggtcaatcaataccattctttcatatgactatgggcgctcaagtgttacgctgaatagaattacttgcaagccagttaaggagacggacggtaattttacagctcatttagtcgcgttagcacacctgattccccaagacagcgtgaacgcaaacgcagcgcaattgttgcaggccctggcggccgttcatgaatcaccaaacgcacatccgtttttgtcgttgaccaagggtgatatatgcctctctttgtatagaagacttcgtttgctgaatcatattcttgataaaaatgttgttttacaaataattgatatcggcaacactgcgctatcagcagcatacgctcttgtaaaactggatcaagcatggtggaatgtgttgagcacctcattccagtacgtctgtgtccttcttgccatcgacacaccggaaagtctttcacatgttgctactgccatgaaaacgttagataatattactcaaattctcggtacacgtattgcttttgaagcacaaaagaccgcaaaactgcttcttgaggattccatgaaaaaaaaaagacaagaaattcagcagcttgagcaggcaactcaccagagatctaatcttgaaactactcacctactcgatattgactgggatgctttgctagatccatcagacacgttaaactttatg

SEQ ID NO: 278 - protein, 546 aa, Saccharomyces cerevisiae
MASPGSTALPHKRQRVRKACVPCRERKRKCNGKSPCEMCVAYGYVCHYIDGRVPSASPQVQQVGETSPDTESRPFVLPGIHRNEQPQPINTQNVTSQNIVDPTKSRYTIQHSAVAFPRCLGLELRSTNPPRLHSFAWHCGIRPEENPNSHVLLSDLVTKEEYYRISKVYFSVVHPIFDVVNPEQLAKNVEKYWDGDVKTLEYGAVIAGVIALGSFFMGSLGHPREMDIVQYAKGILDDPTFSRIPTVEQVSAWVLRTIYLRATSRPHVAWLASCVTIHLSEAIGLHHEIDREDIAISNNVPPKRTTVVSEHTRRLFWCAWSINTILSYDYGRSSVTLNRITCKPVKETDGNFTAHLVALAHLIPQDSVNANAAQLLQALAAVHESPNAHPFLSLTKGDICLSLYRRLRLLNHILDKNVVLQIIDIGNTALSAAYALVKLDQAWWNVLSTSFQYVCVLLAIDTPESLSHVATAMKTLDNITQILGTRIAFEAQKTAKLLLEDSMKKKRQEIQQLEQATHQRSNLETTHLLDIDWDALLDPSDTLNFM

SEQ ID NO: 279 - DNA, 1338 bp, Saccharomyces cerevisiae
atgtcagcaaacagtggtgtaaaacgagccagtaaggcttttaaaacatgtttattttgtaaacggtcacatgttgtatgtgataagcaacgtccatgttctaggtgcgtcaagagggatattgcccatttatgcagggaagatgatattgcggttccaaatgagatgccatcacagcacgaaagttctccgaatgataataatatacagggcaaatatgcaaataaagcacacactggaattccgtctgactatcagaatgaaccagtcaataaaagtggatccacatatggagaggaactgtcaccgaaactagactcctctcttgtaaatgatacaaccagcttgctgcttccgcaacaacctgtatttgtgtccgagaatgttggttcggaattcagttctttgaatgaatttctttctatgctagaaaatcctctattgactcaaacatcactaagttccagcagtgcgagcaatgttcatttggaaaatggctcacaaaccacacaatcgccattagagtaccaaaacgacaatcgtagggatgaaataggagtggcaagacaagaaaataggtcgcctactattatgtcaggttcttccaatagtatctcgaaaggggataaacaagatcaagaaaaggaagagtctcgaattctagcgaatgcaaacgaaaacagtgcaccgacaccgaaggaacaattctttttaacagcggcggatccgtcaacagagatgacaccagaacaccggctgaagttggtcataaatgcgaagcttgaagcaggattattgaagccgtataattatgccaaggggtatgcaagactacaagactacatggacaaatatatgaatcagtcttccaagcaaaggattctgaaaccactatccaccattagaccggcgtttagaaccattgcgcgttcattgaaggatgttgacttagttttagtggaggagagcttcgagaggatgttattatcttatgatcgtgttttcacctctatgagcatgccagcgtgcttgtgtaggcgtaccggtgagatttacagagccaataaagagtttgcttcactggttgactgcacagtcgatgatttacgcgatggaaagcttgcgatctacgagttgatgacagaagaaagcgctgtgaatttctgggaaaaatacgggtccatagcgtttgataagggtcagaaggctgttttaacaagttgtagtcttcgaaccaaagatggaatccgcaaacggccatgctgttttagtttcactatcagaagggataggtacaacatcccaatttgcatcgtcgggaatttcatccctttgtca

SEQ ID NO: 280 - protein, 446 aa, Saccharomyces cerevisiae
MSANSGVKRASKAFKTCLFCKRSHVVCDKQRPCSRCVKRDIAHLCREDDIAVPNEMPSQHESSPNDNNIQGKYANKAHTGIPSDYQNEPVNKSGSTYGEELSPKLDSSLVNDTTSLLLPQQPVFVSENVGSEFSSLNEFLSMLENPLLTQTSLSSSSASNVHLENGSQTTQSPLEYQNDNRRDEIGVARQENRSPTIMSGSSNSISKGDKQDQEKEESRILANANENSAPTPKEQFFLTAADPSTEMTPEHRLKLVINAKLEAGLLKPYNYAKGYARLQDYMDKYMNQSSKQRILKPLSTIRPAFRTIARSLKDVDLVLVEESFERMLLSYDRVFTSMSMPACLCRRTGEIYRANKEFASLVDCTVDDLRDGKLAIYELMTEESAVNFWEKYGSIAFDKGQKAVLTSCSLRTKDGIRKRPCCFSFTIRRDRYNIPICIVGNFIPLS

SEQ ID NO: 281 - DNA, 804 bp, Saccharomyces cerevisiae
atgaagccgaacaatcgaacttgtgatgtaattaccaacaaagatgaatctcttcctgcacttttgctgcctgcactgaacagttacacctgtgacgattcattgctaaaaggacaaatttcaagcaatggcagatatcaaccattcgggttttctgattgctctttactgccaaagcgtttaaacattcaggcagggcaaggatctatgccagtttcttcgattcaatgtgcagaccacagttatagtaattggcaaaaagaatccgaaaagactaagcttcccaagcttggttgcccaacagagtacactgaatactataaaactgtttcttccggcgaaacaaccgattcagcggttgtttcatctatagcaacgaacagactcaaaagaaaacgtcagagggacggcccaagttgtgactcttgtaggataaagaaaataaaatgcaatgcaacaatcattatctttttacaggataggaacctaatttcatcaatttcttcaaatttgcattatacactttcccaagacgacataaaccagtttcgaatgaagtttttcaggaaactgcctgacgtgatgggcacatatgaagtcataaaacaccttgataaaatagtccttttcaaagcctgcacctcttgcagtagaagaaaccaaaaaaatggaaagtgtcttttttcgagaggatttacaaaatctgatatgaacgtatttcccaagataaatagtaaacttaaagacaaaagtatcttcgagatgactgtcgatgattatgttgccgctggcttccaaaccctt

SEQ ID NO: 282 - protein, 268 aa, Saccharomyces cerevisiae
MKPNNRTCDVITNKDESLPALLLPALNSYTCDDSLLKGQISSNGRYQPFGFSDCSLLPKRLNIQAGQGSMPVSSIQCADHSYSNWQKESEKTKLPKLGCPTEYTEYYKTVSSGETTDSAVVSSIATNRLKRKRQRDGPSCDSCRIKKIKCNATIIIFLQDRNLISSISSNLHYTLSQDDINQFRMKFFRKLPDVMGTYEVIKHLDKIVLFKACTSCSRRNQKNGKCLFSRGFTKSDMNVFPKINSKLKDKSIFEMTVDDYVAAGFQTL

SEQ ID NO: 283 - DNA, 1410 bp, Saccharomyces cerevisiae
atgagtattgtaagacagtcatgtgattgctgtcgcgttcgtcgagtgaagtgtgataggaatagaccgtgtgatcgttgccgtcagcgcaatttgagatgcacttatttacaaccgttaaggaaacgaggtcccaagtccatcggagaaagcaaccttgaaagagcagctgaaatacagatggtgactgtaaacaataacatcatggcggccccagtaatgtataaaaaggttccaaagaaggtgattgatcaatgtttgagactatatcacgatcaactatacgtgatttggccaatgctcagttacgatgatctttacaagcttttggaggaaaattatgaggactgcagcacttattggtttttagtgtctctatctgcagcaactcttagtgatctgcatacaaaaatagaatacaagaagggatttttttttgctggagaacaattgtgtaatctttgtatgtcatcgcgacggtttttcgacgatctcagtaatagtgatatatttcgaattatgacatattattgtttgcatcgttgttatgcacagtttgctgatacaagaacctcatacagactttcttgtgaggctattggcctcataaaaatagctggatttcatcgggaagaaacttatgagtttcttccatttggtgagcaacaacttataagaaaggtttactatctgcttctcatgacagagaggtactatgccgtatacattaaatgtgtaacaagtttggataccactatatctccaccacaacccgaaatcgtaactgattcccgactttctttggatagttttcttgaggtgattaaagtattcactgttcctgggaaatacttttacgatgccttagctaccaacagtgttaatggttcctatactgaagactctctaaaaaggatatggaatgaacttcacataagctcacttgatatagagccatactcttacggatacatagactatctcttttctcggcactgggtcaggactctagcatggaagttggtactaaataagaaggatatgcggatgaattttttttcgaatactaacgccacacacattccagtcgaaatagccaaggatatgttacaggatacacttttaactccaatcgacctatatgatgtgcatggtcctgtgataccaatgaaggcgctagaaatagccaatgcattggtagacgtcgtaagtaagtatgatcacaatatgaagttggaggcttggaatattttgtgcgatgtatctaagttcgttttctccctgaaacattgcaatcataaaatgtttcaaaggttttcaactaaatgtcagagtgctctaatcgatttgcctatctctagaccactgcgcctaaatgatgattccaaggatgaagtcgacattattccc

SEQ ID NO: 284 - protein, 470 aa, Saccharomyces cerevisiae
MSIVRQSCDCCRVRRVKCDRNRPCDRCRQRNLRCTYLQPLRKRGPKSIGESNLERAAEIQMVTVNNNIMAAPVMYKKVPKKVIDQCLRLYHDQLYVIWPMLSYDDLYKLLEENYEDCSTYWFLVSLSAATLSDLHTKIEYKKGFFFAGEQLCNLCMSSRRFFDDLSNSDIFRIMTYYCLHRCYAQFADTRTSYRLSCEAIGLIKIAGFHREETYEFLPFGEQQLIRKVYYLLLMTERYYAVYIKCVTSLDTTISPPQPEIVTDSRLSLDSFLEVIKVFTVPGKYFYDALATNSVNGSYTEDSLKRIWNELHISSLDIEPYSYGYIDYLFSRHWVRTLAWKLVLNKKDMRMNFFSNTNATHIPVEIAKDMLQDTLLTPIDLYDVHGPVIPMKALEIANALVDVVSKYDHNMKLEAWNILCDVSKFVFSLKHCNHKMFQRFSTKCQSALIDLPISRPLRLNDDSKDEVDIIP

SEQ ID NO: 285 - DNA, 2430 bp, Saccharomyces cerevisiae
atgaaaagaagaagcgatgctttgttgggaagtttccaggccaccaacgttacgccgccaagcgataatagtaatagtacggccggtggagccaatggaagtaactcaggaacaccaacttctactagcggtaagaagagaaacaagcttataaaatcttgtggcttttgcagaaggagaaaacttcgttgtgatcagcaaaaacctatgtgttctacatgcatttctagaaacttaacaacctgtcaatatgctgaagaattcaacaaaaacatcgaaaagaaagctacctatggtccctatcctaacgccgatttacttaagaaagttgaagaactagaaaacaaaatacgtattctagaagctgaaaaaaacactaattcgtctgcgagctccatgtacacttcgccaaatttccctcctttaggcactagtgtaggtagaggttctactgaaacttcatctccattacccgatggtgtaataaatccatatgccgaccggtactacctacaaagtaaacattccggaagatcaacactatacggccccacttctatgagaacccaaattgcaaatagtaattgggggttcattgaaaaatataaacaattatgggcgaaggttaaagtagaaagaaataaatggaagcaaaacaaccaaaaaacgatgtgcagggaactaggccttttggatgagtcggattggcagccagatccattaatcaaacagatatgtcgtttcctaccatcatataacaaagctttgtctattttagatgatttctttaatgatggagcatgcaatgagatcaacgtgattcttgataaggcaaaagttagaagagactttttagattatttcatgcccgaaaaagaggtaaaggcggaaggtgacagatccatagtttatattttatccaatccaaagaaaaattattacaaagctgctgtgatactattaatcctatgtctgaaatacttccatacagatgtcccaaccccaattgagaagttctttactttactaaagggggcctccaccgctaaggtgttctacattgagcgtgcacaaatgttaatacttttctactaccatcgtgaaacatattcattcggtggagatggctccgatttggttaatataaatgaatgtttagttactacggttactacaatagggttgcatttaaacattagagaaactttcaaggaacatgaggtttttatgggtagcatcgaaagtttagaaaatgtctggttaatggcaatatttatcgattataacatatcttgtaacgttggtagacccttattgattaacaaattttatctagacgaaaaccaagatcattgcatattgaatagtaaaagtaaaacatatgaggggaagctgaaaagatatttaaaacttacaaggccaatgttgttaactctttatgatagagataaattcccggatttgaaagcttattccaagcgaattatcaattttgtagaagaagaacttggtccacttggacattacacaggtgaaaatatatcggaagaagttccattaagggaaagtagaattttaagtatggcagtcggactattattgtcgttttatgcactaatacattctgtgctgaaagtcagaaacatagaatccaaaaataatacgtttcaattggttttgatcaatttttccatcattgtgaataccacaattcgatgctatcgtatcgacaaagcactttacccagagaaattcgaagcctccaacccgcacttaccgccacatatggcgttatcaatgagcctcacggcagggcttttttccaaaacattggtgtttttttgttctctgatctactttaagttgacgcttttcgaaaatggactatgtctatccaacgatatggaagttggatggtcggatttgacgaaattgactgttcctttagacaaggatctatctttaggtacagcaatgagcttgtactcgtcaatcttcgatcgcttgttcacggtcggaaataaagaattaatacgcacaatgcatagatcatcacaatttgtgatagagctagctattgaaaggacctataggactattcttggcaacgttattgaattcagaaagttgaccgaggaaacatggctagcacaaatcaaacaagaactagatccgcagagcgataatccatcatcagaagctaaaattgtgagtgataggcagcgggatctcagccttgcagttccaacgcccacgccctcaataattccaatgttaccctcgcctggtgaaactaagaaccatgcaaagagtcaatcagagatcattcagatgctgacagatgaattttgggcaaattataactcaggctgggaagagttgattaatcaatctgaattttccactcttttcgatgattacaaagacaat

SEQ ID NO: 286 - protein, 810 aa, Saccharomyces cerevisiae
MKRRSDALLGSFQATNVTPPSDNSNSTAGGANGSNSGTPTSTSGKKRNKLIKSCGFCRRRKLRCDQQKPMCSTCISRNLTTCQYAEEFNKNIEKKATYGPYPNADLLKKVEELENKIRILEAEKNTNSSASSMYTSPNFPPLGTSVGRGSTETSSPLPDGVINPYADRYYLQSKHSGRSTLYGPTSMRTQIANSNWGFIEKYKQLWAKVKVERNKWKQNNQKTMCRELGLLDESDWQPDPLIKQICRFLPSYNKALSILDDFFNDGACNEINVILDKAKVRRDFLDYFMPEKEVKAEGDRSIVYILSNPKKNYYKAAVILLILCLKYFHTDVPTPIEKFFTLLKGASTAKVFYIERAQMLILFYYHRETYSFGGDGSDLVNINECLVTTVTTIGLHLNIRETFKEHEVFMGSIESLENVWLMAIFIDYNISCNVGRPLLINKFYLDENQDHCILNSKSKTYEGKLKRYLKLTRPMLLTLYDRDKFPDLKAYSKRIINFVEEELGPLGHYTGENISEEVPLRESRILSMAVGLLLSFYALIHSVLKVRNIESKNNTFQLVLINFSIIVNTTIRCYRIDKALYPEKFEASNPHLPPHMALSMSLTAGLFSKTLVFFCSLIYFKLTLFENGLCLSNDMEVGWSDLTKLTVPLDKDLSLGTAMSLYSSIFDRLFTVGNKELIRTMHRSSQFVIELAIERTYRTILGNVIEFRKLTEETWLAQIKQELDPQSDNPSSEAKIVSDRQRDLSLAVPTPTPSIIPMLPSPGETKNHAKSQSEIIQMLTDEFWANYNSGWEELINQSEFSTLFDDYKDN

SEQ ID NO: 287 - DNA, 1164 bp, Candida albicans; identical to SEQ ID NO: 123

SEQ ID NO: 288 - protein, 388 aa, Candida albicans
MSSIPNINWNDPNNGKSNTSRQSQPQPQLPSNVSPPNSRAVPTSGSIGGPQYGSSQFSNEYSRNPNTIGGPPFPLQLNQRGYMPNTGYPVQQTAQQRSGDKLQQVHSQQQQQQQQQQQPLYQQYPPQSVGYLAGDVYNPQHQEYVQMNQLPNQHYNLQQRQQAQGQQLKLQLNEQNAMMSASTQQYPVQDFTNPYPNAQNPAEQQQQQQPLRTQSQQWDGYQSQPLYSAAGNTIPSSIQQQIPPQNLSPSEQQQVKQQQPLPPEQGTKKKPGRKPKLRKLSELSSETPQVPKTASSSSSSPTAVNSGKPITKRSRMGCLTCRQRKKRCCETRPRCTECTRLRLNCTWPKPGTEHKNKPKDQKDDENTIEHAEFGRIKVLRGIVEYRSK

SEQ ID NO: 289 - DNA, 1491 bp, Schizosaccharomyces pombe
atgaaacggaatagaacgggtagtattaattcaaatccgctatatattcccaacccaaacgtcgagcctacgcccaagcccacaaaaagaagaacgaaaactggatgtttaacatgtcgccgtcgcaggatcaagtgcgacgaaaccaaacctttttgtttgaactgcacaaagacaaatagggaatgtgaaggttatccaaattcagctgctcaaatgcaagccatggggagtgtatcgcctcctgagctaagcgttcattctgctcaacagccattgatacctacttcaattgcttcaagtagcgctcaaaccggagacactttttccggctcttcacaatccaattttaatacaaatgatcttaatcagatgacctcctcctccaatttatccaccgttaccccaatcaaacaggatcatcaaaaacctatgaatttacaaggatttccaagtgcttatcaacagcatcaataccttcaatccaatcataacgttcctacaaataattcttctagcgctacttcgtctacaaaaccctctgtacaatcggtgggtcaggcctcttacccttttctttcatcagtttccaatttcccttcaaactttaattccgaactgtttccgttttattttcacgatgtcgtaccttctatttgtgcatttgaatttgataataacatagccttgcatttttggtcagtcactgttccccagtttgctcaatcgatgccttgtattgctaattctttaatggcttttgcgtctattaagaagctcgacgtttttggtgcttacagtcatttgaccagagctcttcgctgtccaatgcctggtcccaattcttttgaatacctgttggtttctgcatttttgactctcactcagctcaatctcccagcctatgatctcaatttttgtaataattttattagaaagttaagttggtcttcgtctaccaaatcaaattatgtcagcttattgattgctatggtcgttcgtgaactagtttttgcaattcttcctcgtgggtgtatctgggggtttaatggaaagcctttatcggaagtttctgtttctcgaagtcatgcacctgtttcggattctttgtttactattggattggacattctctctcaaccaaccttgtctgatgatttgcatcgagaacgaatggttgcttggcgagatgaatatcatgtgcacttgtattcagcatcaagaagtcctcttactaaagttatagattgtgtaggacatgccgttaccaaaaacaataatgacgttctttctggcttacagcaattaatgcaagaagaatgcacagatattgcagtattacgcacttcctatttatgcgtattatctctacaaaatgtttttgcatcaaactctaaagaatttaaacttcgggcacaaatcgaatctcatttcggaagattgatgctagaacattttatggattgcaatgtcttaaatcgaccagtactt

SEQ ID NO: 290 - protein, 497 aa, Schizosaccharomyces pombe
MKRNRTGSINSNPLYIPNPNVEPTPKPTKRRTKTGCLTCRRRRIKCDETKPFCLNCTKTNRECEGYPNSAAQMQAMGSVSPPELSVHSAQQPLIPTSIASSSAQTGDTFSGSSQSNFNTNDLNQMTSSSNLSTVTPIKQDHQKPMNLQGFPSAYQQHQYLQSNHNVPTNNSSSATSSTKPSVQSVGQASYPFLSSVSNFPSNFNSELFPFYFHDVVPSICAFEFDNNIALHFWSVTVPQFAQSMPCIANSLMAFASIKKLDVFGAYSHLTRALRCPMPGPNSFEYLLVSAFLTLTQLNLPAYDLNFCNNFIRKLSWSSSTKSNYVSLLIAMVVRELVFAILPRGCIWGFNGKPLSEVSVSRSHAPVSDSLFTIGLDILSQPTLSDDLHRERMVAWRDEYHVHLYSASRSPLTKVIDCVGHAVTKNNNDVLSGLQQLMQEECTDIAVLRTSYLCVLSLQNVFASNSKEFKLRAQIESHFGRLMLEHFMDCNVLNRPVL

SEQ ID NO: 291 - DNA, 3204 bp, Saccharomyces cerevisiae
atgcgaggcttgacacctaagaacggtgtacatattgagacgggtccggatacagaatcgtccgcggactccagcaacttttctacaggtttcagcggcaagattcgtaagccaaggtcgaaagtaagtaaagcgtgcgataactgtagaaaaagaaagataaaatgtaatgggaagtttccctgcgcaagctgtgagatatattcatgtgagtgcacgttcagcactagacaaggtggcgctcgaataaaaaaccttcacaagacgagtttggaaggtacaaccgtacaagtcaaagaggaaacagattccagttcgacttctttttctaatcctcagcgatgtacagacgggccatgcgcagtggaacaaccaacgaaattttttgagaatttcaagctaggtggtcgtagtagtggtgataatagcggaagtgatgggaagaatgacgacgatgtgaatagaaacggtttttatgaagacgatagcgaatcacaggcaactttgacatctctacaaaccactctgaaaaatttgaaggagatggctcatttaggtacacatgtaacctcagccatcgagagcattgaacttcagataagtgacttgcttaagcgatgggaacccaaagtgaggaccaaagaattagcaacaacgaaattttaccctaataaatcaatagaaactcaattgatgaaaaacaaatactgtgatgtggtacatttgacaagatatgccgcttggtcaaacaataagaaggaccaagatacttctagtcaacctttgatcgacgaaatctttggtttgtactctcctttccaatttttgtcacttcaaggtattggtaaatgtttccaaaattatagatccaaatccaaatgcgagatttttcccaggaccgccaaggaaaccatatacatcatgttaaggtttttcgacgtttgttttcatcacatcaaccaaggctgtgtctccatagctaatcccctggaaaactacctacagaaaatgaatcttttaccttcaaccccatcttcgatatcatctgcagggagcccgaatacagcacacacaaaatcgcatgttgcgttagtgataaatcacttaccgcagccctttgtgagaaatataaccggaataagtaattctgagctactaagcgaaatgaataatgatatcagcatgtttggcattttattgaagatgttggatatgcataaaaattcctaccagaacttcctaatggaaatcacatctaacccctccgtggctaaaaacacgcagtcaattgatgtcttgcaggaattcatccattattgtcaagctggagaggcgctaatcgccttatgttacagctattataattctacattatacaactacgtggacttcacatgcgacataacgcatttagagcaacttctatactttttggatctgctattttggctatcggaaatatacggttttgaaaaagtcttgaacgtagcagttcattttgtttcaagagttggtttatcaaggtgggaattttacgtgggtcttgatgaaaactttgctgaaagaagaagaaatctctggtggaaagctttctatttcgagaaaactttagcctctaaacttggctatccttcgaacattgatgactccaaaatcaattgtttattacctaagaattttcgagatgttgggttcttggataatagagattttatcgagaacgtccacttagttcgcaggagcgaagcttttgacaacatgtgcatatccgacttaaaatactatggcgaattagctgtcttacaaatagtcagccatttctcatcatctgttttattcaatgaaaaattcacgtcaattaggaatacatcaaaaccatctgttgttagagagaaactactcttcgaggtactcgagatttttaacgaaacagaaatgaaatatgatgctatcaaagagcaaactggaaaattgttcgatattgcattctctaaagatagtactgaactcaaagtttcaagagaggataagattatggcttcaaaatttgttctattttacgagcaccatttctgcagaatggttaacgaatctgataatattgtcgccagattatgcgtgcacagaaggccctcaatactaattgaaaacttgaaaatataccttcacaagatttacaaatcatggaccgatatgaacaaaatcttattagactttgacaacgattattccgtataccgttcgttcgcccattattctatcagttgcattattttggtatcacaagcattctcagtggccgaattcattaaagtaaatgacgttgtgaatatgattagagtcttcaaaagatttttggatataaaaattttttccgaaaatgagaccaatgagcatgtcttcaacagccaaagctttaaagactatacaagagctttttctttcctgacaatcgtcactcgtatcatgcttttggcatacggagagtcctctagcaccaacctcgatgttatctccaaatatattgatgagaatgcgccagatttaaaaggtataatagaacttgtcttggatacaaactcttgcgcttatcgatttttattagaacctgttcagaagtcaggattccatttaacggtctcacaaatgttgaaaaatagaaagtttcaggaaccactaatgtcaaatgaagataataagcagatgaagcataattcgggaaaaaatttgaatccggatctcccaagtcttaagacgggcacttcatgcttactaaatggcattgaatcgcctcaattgccattcaatggtcgctcagcaccttccccagtgagaaacaactcactaccggagtttgcacaattgccttcatttaggtcattatccgtgtctgatatgatcaatcccgattacgcgcaaccaacaaatgggcaaaataatacgcaagtccaatctaataaaccaatcaatgctcagcagcaaatacccacttcagtacaagtaccatttatgaacacaaatgaaatcaataacaacaacaacaacaacaacaacaataaaaacaatattaacaatattaacaacaacaacagtaacaatttttctgcaactagttttaatttggggacactagatgaatttgttaataacggtgatcttgaggacctctacagtatcctgtggagcgacgtttatccagatagt

SEQ ID NO: 292 - protein, 1068 aa, Saccharomyces cerevisiae
MRGLTPKNGVHIETGPDTESSADSSNFSTGFSGKIRKPRSKVSKACDNCRKRKIKCNGKFPCASCEIYSCECTFSTRQGGARIKNLHKTSLEGTTVQVKEETDSSSTSFSNPQRCTDGPCAVEQPTKFFENFKLGGRSSGDNSGSDGKNDDDVNRNGFYEDDSESQATLTSLQTTLKNLKEMAHLGTHVTSAIESIELQISDLLKRWEPKVRTKELATTKFYPNKSIETQLMKNKYCDVVHLTRYAAWSNNKKDQDTSSQPLIDEIFGLYSPFQFLSLQGIGKCFQNYRSKSKCEIFPRTAKETIYIMLRFFDVCFHHINQGCVSIANPLENYLQKMNLLPSTPSSISSAGSPNTAHTKSHVALVINHLPQPFVRNITGISNSELLSEMNNDISMFGILLKMLDMHKNSYQNFLMEITSNPSVAKNTQSIDVLQEFIHYCQAGEALIALCYSYYNSTLYNYVDFTCDITHLEQLLYFLDLLFWLSEIYGFEKVLNVAVHFVSRVGLSRWEFYVGLDENFAERRRNLWWKAFYFEKTLASKLGYPSNIDDSKINCLLPKNFRDVGFLDNRDFIENVHLVRRSEAFDNMCISDLKYYGELAVLQIVSHFSSSVLFNEKFTSIRNTSKPSVVREKLLFEVLEIFNETEMKYDAIKEQTGKLFDIAFSKDSTELKVSREDKIMASKFVLFYEHHFCRMVNESDNIVARLCVHRRPSILIENLKIYLHKIYKSWTDMNKILLDFDNDYSVYRSFAHYSISCIILVSQAFSVAEFIKVNDVVNMIRVFKRFLDIKIFSENETNEHVFNSQSFKDYTRAFSFLTIVTRIMLLAYGESSSTNLDVISKYIDENAPDLKGIIELVLDTNSCAYRFLLEPVQKSGFHLTVSQMLKNRKFQEPLMSNEDNKQMKHNSGKNLNPDLPSLKTGTSCLLNGIESPQLPFNGRSAPSPVRNNSLPEFAQLPSFRSLSVSDMINPDYAQPTNGQNNTQVQSNKPINAQQQIPTSVQVPFMNTNEINNNNNNNNNNKNNINNINNNNSNNFSATSFNLGTLDEFVNNGDLEDLYSILWSDVYPDS

SEQ ID NO: 293 - DNA, 3189 bp, Saccharomyces cerevisiae
atgcgaggcttgacacctaagaacggtgtacatattgagacgggtccggatacagaatcgtccgcggactccagcaacttttctacaggtttcagcggcaagattcgtaagccaaggtcgaaagtaagtaaagcgtgcgataactgtagaaaaagaaagataaaatgtaatgggaagtttccctgcgcaagctgtgagatatattcatgtgagtgcacgttcagcactagacaaggtggcgctcgaataaaaaaccttcacaagacgagtttggaaggtacaaccgtacaagtcaaagaggaaacagattccagttcgacttctttttctaatcctcagcgatgtacagacgggccatgcgcagtggaacaaccaacgaaattttttgagaatttcaagctaggtggtcgtagtagtggtgataatagcggaagtgatgggaagaatgacgacgatgtgaatagaaacggtttttatgaagacgatagcgaatcacaggcaactttgacatctctacaaaccactctgaaaaatttgaaggagatggctcatttaggtacacatgtaacctcagccatcgagagcattgaacttcagataagtgacttgcttaagcgatgggaacccaaagtgaggaccaaagaattagcaacaacgaaattttaccctaataaatcaatagaaactcaattgatgaaaaacaaatactgtgatgtggtacatttgacaagatatgccgcttggtcaaacaataagaaggaccaagatacttctagtcaacctttgatcgacgaaatctttggtttgtactctcctttccaatttttgtcacttcaaggtattggtaaatgtttccaaaattatagatccaaatccaaatgcgagatttttcccaggaccgccaaggaaaccatatacatcatgttaaggtttttcgacgtttgttttcatcacatcaaccaaggctgtgtctccatagctaatcccctggaaaactacctacagaaaatgaatcttttaccttcaaccccatcttcgatatcatctgcagggagcccgaatacagcacacacaaaatcgcatgttgcgttagtgataaatcacttaccgcagccctttgtgagaaatataaccggaataagtaattctgagctactaagcgaaatgaataatgatatcagcatgtttggcattttattgaagatgttggatatgcataaaaattcctacaagaacttcctaatggaaatcacatctaacccctccgtggctaaaaacacgcagtcaattgatgtcttgcaggaattcatccattattgtcaagctggagaggcgctaatcgccttatgttacagctattataattctacattatacaactacgtggacttcacatgcgacataacgcatttagagcaacttctatactttttggatctgctattttggctatcggaaatatacggttttgaaaaagtcttgaacgtagcagttcattttgtttcaagagttggtttatcaaggtgggaattttacgtgggtcttgatgaaaactttgctgaaagaagaagaaatctctggtggaaagctttctatttcgagaaaactttagcctctaaacttggctatccttcgaacattgatgactccaaaatcaattgtttattacctaagaattttcgagatgttgggttcttggacaatagagattttatcgagaacgtccacttagttcgcaggagcgaagcttttgacaacatgtgcatatccgacttaaaatactatggcgaattagctgtcttacaaatagtcagccatttctcatcatctgttttattcaatgaaaaattcacgtcaattaggaatacatcaaaaccatctgttgttagagagaaactactcttcgaggtactcgagatttttaacgaaacagaaatgaaatatgatgctatcaaagagcaaactggaaaattgttcgatatcgcattctctaaagatagtactgaactcaaagtttcaagagaggataagattatggcttcaaaatttgttctattttacgagcaccatttctgcagaatggttaacgaatctgataatattgtcgccagattatgcgtgcacagaaggccctcaatactaattgaaaacttgaaaatataccttcacaagatttacaaatcatggaccgatatgaacaaaatcttattagactttgacaacgattattccgtataccgttcgttcgcccattattctatcagttgcattattttggtatcacaagcattctcagtggccgaattcattaaagtaaatgacgttgtgaatatgattagagtcttcaaaagatttttggatataaaaattttttccgaaaatgagaccaatgagcatgtcttcaacagccaaagctttaaagactatacaagagctttttctttcctgacaatcgtcgctcgtatcatgcttttggcatacggagagtcctctagcaccaacctcgatgttatctccaaatatattgatgagaatgcgccagatttaaaaggtataatagaacttgtcttggatacaaactcttgcgcttatcgatttttattagaacctgttcagaagtcaggattccatttaacggtctcacaaatgttgaaaaatagaaagtttcaggaaccactaatgtcaaatgaagataataagcagatgaagcataattcgggaaaaaatttgaatccggatctcccaagtcttaagacgggcatttcatgcttactaaatggcattgaatcgcctcaattgccattcaatggtcgctcagcaccttccccagtgagaaacaactcactaccggagtttgcacaattgccttcatttaggtcattatccgtgtctgatatgatcaatcccgattacgcgcaaccaacaaatgggcaaaataattcgcaagtccaatctaataaaccaatcaatgctcagcagcaaatacccacttcagtacaagtaccatttatgaacacaaatgaaatcaacaacaacaacaataaaaacaatattaacaatattaacaacaacaacagtaacaatttttctgcaactagttttaatttggggacactagatgaatttgttaataacggtgatcttgaggacctctacagtatcctgtggagcgacgtttatccagatagt

SEQ ID NO: 294 - protein, 1063 aa, Saccharomyces cerevisiae
MRGLTPKNGVHIETGPDTESSADSSNFSTGFSGKIRKPRSKVSKACDNCRKRKIKCNGKFPCASCEIYSCECTFSTRQGGARIKNLHKTSLEGTTVQVKEETDSSSTSFSNPQRCTDGPCAVEQPTKFFENFKLGGRSSGDNSGSDGKNDDDVNRNGFYEDDSESQATLTSLQTTLKNLKEMAHLGTHVTSAIESIELQISDLLKRWEPKVRTKELATTKFYPNKSIETQLMKNKYCDVVHLTRYAAWSNNKKDQDTSSQPLIDEIFGLYSPFQFLSLQGIGKCFQNYRSKSKCEIFPRTAKETIYIMLRFFDVCFHHINQGCVSIANPLENYLQKMNLLPSTPSSISSAGSPNTAHTKSHVALVINHLPQPFVRNITGISNSELLSEMNNDISMFGILLKMLDMHKNSYKNFLMEITSNPSVAKNTQSIDVLQEFIHYCQAGEALIALCYSYYNSTLYNYVDFTCDITHLEQLLYFLDLLFWLSEIYGFEKVLNVAVHFVSRVGLSRWEFYVGLDENFAERRRNLWWKAFYFEKTLASKLGYPSNIDDSKINCLLPKNFRDVGFLDNRDFIENVHLVRRSEAFDNMCISDLKYYGELAVLQIVSHFSSSVLFNEKFTSIRNTSKPSVVREKLLFEVLEIFNETEMKYDAIKEQTGKLFDIAFSKDSTELKVSREDKIMASKFVLFYEHHFCRMVNESDNIVARLCVHRRPSILIENLKIYLHKIYKSWTDMNKILLDFDNDYSVYRSFAHYSISCIILVSQAFSVAEFIKVNDVVNMIRVFKRFLDIKIFSENETNEHVFNSQSFKDYTRAFSFLTIVARIMLLAYGESSSTNLDVISKYIDENAPDLKGIIELVLDTNSCAYRFLLEPVQKSGFHLTVSQMLKNRKFQEPLMSNEDNKQMKHNSGKNLNPDLPSLKTGISCLLNGIESPQLPFNGRSAPSPVRNNSLPEFAQLPSFRSLSVSDMINPDYAQPTNGQNNSQVQSNKPINAQQQIPTSVQVPFMNTNEINNNNNKNNINNINNNNSNNFSATSFNLGTLDEFVNNGDLEDLYSILWSDVYPDS

SEQ ID NO: 295 - DNA, 2649 bp, Saccharomyces cerevisiae
atgatggacatgcaagtgagaaaagtgaggaagccgcctgcttgcacccaatgcaggaagagaaagatcgggtgcgacagggcaaaaccgatatgtgggaattgcgtcaagtataacaagccggactgtttttatccagatggacctggtaagatggtcgctgtgccctctgcgtccgggatgtccacgcacggcaatggccaaggttccaaccattttagtcagggaaacggtgtaaatcagaaaaacgtaatgattcaaacgcagtatccgattatgcaaacgtcgatagaggcattcaacttctcgttcaacccctctgtggatactgcgatgcagtggaccaaggccgctagctaccagaataataacaccaataataatactgctcctcgtcagaatagtagtaccgttagtagtaatgttcatggaaacactattgtgagaagcgatagtccagatgtgccctccatggatcagattagagaatataacacacgattacaactggttaacgctcaaagttttgactatacagataacccatactcttttaatgttggtatcaatcaagactcggccgttttcgatctaatgacttctccgtttactcaagaggaagtattaatcaaggagatagactttttaaaaaacaaattgcttgatttacaaagcttgcaactgaaaagtttgaaagaaaaatcgaatttaaatgccgacaataccacggcaaacaaaattaacaaaacaggtgagaattctaagaaaggcaaggttgacggtaaaagagccggatttgatcatcagacttcaaggacttctcagtcctcacaaaaatactttacagcgctcacaataacagatgtgcaaagtttagtccaagtgaaaccgttgaaggatacccccaactaccttttcactaaaaacttcatcatttttagagatcattatcttttcaagttctataatattttgcacgatatctgccatattaatcagttcaaagtaagtcctcctaacaataaaaatcaccaacaatatatggaagtttgcaaagttaacttcccaccaaaagcaataattattgagacactaaactctgaatcccttaacaatctgaatattgaagaatttttgccaatctttgacaaaaccctcttactagaatttgttcataactcttttccaaatggtgatacctgtccttcattctcaacggtcgatcttcctttatctcaactgaccaaactaggcgaattaactgtgcttctactgttgttaaacgattcaatgaccctattcaataagcaggctattaataaccatgtttcggcattaatgaataatttgaggttgattcgaagccaaatcacattgataaacctggaatattatgaccaagagacaatcaaatttattgccatcacaaaattttatgaatctctgtacatgcatgatgatcataaatcaagtttagacgaagatttgagctgtctgttaagcttccagataaaagatttcaagttattccattttttgaaaaaaatgtattactcaagacattcgcttctaggtcagtcttcattcatggtacccgctgctgaaaacctatctccgatacctgcctctattgatacgaacgacattcctttaattgctaacgatttaaaattactggaaacgcaagcaaaattgataaatattctgcaaggtgttcctttctacttgccagtaaatttaaccaaaattgaaagtctgttagaaaccttgactatgggcgtgagtaatacagtagacttatattttcatgacaacgaagtcagaaaagaatggaaagacactttaaattttatcaataccattgtttatacaaattttttcctttttgttcaaaacgaatcctctttgtccatggcagttcaacattcttctaacaacaataagacctcgaactctgaaagatgtgcaaaggatctgatgaaaattatttctaatatgcacattttttactcaataacatttaattttatcttccccataaagtcgataaagtcattttcaagcggcaataatcgctttcattctaatggtaaagaatttttattcgcaaatcattttattgaaatcttacagaattttatagcaatcacatttgctattttccaacgttgtgaagtaatattatatgacgaattttacaaaaatctttcaaatgaggagattaatgttcaattgctattgattcatgacaagattttggaaattttaaaaaaaatagaaattatcgtatcctttttacgagatgaaatgaatagcaacggaagtttcaaatctattaaaggtttcaacaaggttttgaatctgattaaatatatgctgagatttagcaagaaaaaacaaaattttgcgagaaactctgataacaataatgttacagattatagtcagtcggcgaagaacaaaaatgttctcttgaaattccccgttagtgaactgaacagaatctatttaaaatttaaggagatttcagattttttaatggaaagagaagttgtccaaaggagtataattattgacaaggatttggaatctgataatctgggtattactacggcaaacttcaacgatttctatgatgcattttataat

SEQ ID NO: 296 - protein, 883 aa, Saccharomyces cerevisiae
MMDMQVRKVRKPPACTQCRKRKIGCDRAKPICGNCVKYNKPDCFYPDGPGKMVAVPSASGMSTHGNGQGSNHFSQGNGVNQKNVMIQTQYPIMQTSIEAFNFSFNPSVDTAMQWTKAASYQNNNTNNNTAPRQNSSTVSSNVHGNTIVRSDSPDVPSMDQIREYNTRLQLVNAQSFDYTDNPYSFNVGINQDSAVFDLMTSPFTQEEVLIKEIDFLKNKLLDLQSLQLKSLKEKSNLNADNTTANKINKTGENSKKGKVDGKRAGFDHQTSRTSQSSQKYFTALTITDVQSLVQVKPLKDTPNYLFTKNFIIFRDHYLFKFYNILHDICHINQFKVSPPNNKNHQQYMEVCKVNFPPKAIIIETLNSESLNNLNIEEFLPIFDKTLLLEFVHNSFPNGDTCPSFSTVDLPLSQLTKLGELTVLLLLLNDSMTLFNKQAINNHVSALMNNLRLIRSQITLINLEYYDQETIKFIAITKFYESLYMHDDHKSSLDEDLSCLLSFQIKDFKLFHFLKKMYYSRHSLLGQSSFMVPAAENLSPIPASIDTNDIPLIANDLKLLETQAKLINILQGVPFYLPVNLTKIESLLETLTMGVSNTVDLYFHDNEVRKEWKDTLNFINTIVYTNFFLFVQNESSLSMAVQHSSNNNKTSNSERCAKDLMKIISNMHIFYSITFNFIFPIKSIKSFSSGNNRFHSNGKEFLFANHFIEILQNFIAITFAIFQRCEVILYDEFYKNLSNEEINVQLLLIHDKILEILKKIEIIVSFLRDEMNSNGSFKSIKGFNKVLNLIKYMLRFSKKKQNFARNSDNNNVTDYSQSAKNKNVLLKFPVSELNRIYLKFKEISDFLMEREVVQRSIIIDKDLESDNLGITTANFNDFYDAFYN

SEQ ID NO: 297 - DNA, 927 bp, Aspergillus terreus
atgacaccgcgacaatcctccccatccgaacactcgcactccgacaacaatgtgcgcaagcgcgtatgtaaagcctgcgatcgctgtcgcctgaaaaagtccaagtgtgacggaggcaacccgtgcggccggtgtcgcgcagacaatgccatctgcgtctttggcgagcgcaaaaaggcgcatgacaaagtgtaccccaagggatacgttgagatgcttgaacagcagcaggcctggctcgtctacggcctgcaggaactgtaccgccgcaccagcgacggcgaaggctggcccggcgagccgctcaagtgcgaggccaacggccacccgctcacgcacgacctgctcacccgcctcggcgccctcgaccaggccaagggcgagcgcttcgaggaaaaccccgacgccatgcagcaggagctctggcgccagaacgccggccacatgcagcgccaggactcgtccgacgccagctccgacagcgcccactcgcccgtcgtcccctccgtcgccgccgccgccgccgctcgcttcgccgaccccttcgcccagccccagctgccccccaccccgccaaatatcagccccagcgcccgccccgtcaagtccgagtcgtcgcagatgccgccggcctttgcgtccgcgccgctgggcatgcagggcgtcgtcaaccccatggtgctgcaggcgccgcagcagcaacagcagcagcagcagtcgtggggagggaatgggttcggcgggttcgatgatatcgacatgatgggcacgacggattttaccaacctgtcgtttgacgatccgctgtcgtcgccgatgttcaatcgacccgtgccgatcaactgcatgtcgtatatggacttgaagggcgactacgacgatctgaaccagtttgtcaatgcgaatgcgccggagatcgcgtcgacg

SEQ ID NO: 298 - protein, 309 aa, Aspergillus terreus
MTPRQSSPSEHSHSDNNVRKRVCKACDRCRLKKSKCDGGNPCGRCRADNAICVFGERKKAHDKVYPKGYVEMLEQQQAWLVYGLQELYRRTSDGEGWPGEPLKCEANGHPLTHDLLTRLGALDQAKGERFEENPDAMQQELWRQNAGHMQRQDSSDASSDSAHSPVVPSVAAAAAARFADPFAQPQLPPTPPNISPSARPVKSESSQMPPAFASAPLGMQGVVNPMVLQAPQQQQQQQQSWGGNGFGGFDDIDMMGTTDFTNLSFDDPLSSPMFNRPVPINCMSYMDLKGDYDDLNQFVNANAPEIAST

SEQ ID NO: 299 - DNA, 2577 bp, Penicillium chrysogenum
atgatcatgccataccccaccaaaatgaccccgacacctccttctacaaattcctcgagtgctggccactctccagattacagagtcgtccggaaacgaaaccgggtacctttgtcatgtgggccttgtcggcacagaaagctgaaatgcaatcgtacacatccttgcgaaaattgtgtcaaacgaggggatgctgcttcatgtaactatgcgcaacccaactcgcgcaagaagaacccccagcaatcatctactacaccggatgatatgcaaaaccgcatcgatcggttagaaggcttggtcctttcattgatgacaaacggctcacagtctgcgggcccgaatgctgccatggccgcgatttcaggtgaaagtagtgcgggctccacccggttctcccatgacctcgacgccgaagaggagggtatggagggcgccgaagagagtgacacggaccaggtgacgaagtcatttggcatcatgaagatggacaataacaagtcctattacatcagtgacgctcattgggcgtctgtattgagtgatatcgccgaggtgaaaagttttttctcaacgcacaagaagcaaatggatgcgcaaattgagaaagtcaaagcgtcccaaccacctagtgaggcatcaggctcgactttgttgtttggtatcaataaaccaatgagccgtggggagatcatgtccggtttgccttcgaagtatacaactgacattcttattgctcgctatttcaactgctacgaccctgcaactcatgttcttcatgggccgacattccaagctcagtataataaacattgggatgatcctagcgcgaccgaactcgtctggatcgccatgctctttggaatgatgagattagcgatgctgtcttaccaccgcgaaggcgacgagccacccgaattccggggcaagtccttggacatggccggcggattccgaaattctgtagcacagtgcctgacattggctgactacacgaaaccccaccccttcttgattgaggcgcttgtatttcacttgcatggcgatttctctctgacccgagaggcggacatctccatctgggtcatgactggcgttgttactcgcctagcaatgcgatcagggtatcaccgtgactccaaaatgtacccaaacatcacacctttccagggtgagatgcgacgtcgggtgtggacttttgtgcgccaagccgacattctattctcataccaggtcggcttgccgggcatgatccgaggtgcagatagcgatactgaactgccacggaatttgtacgatgatgattttgatgaagattgcaaggagctcccgccgccacgtcaactgaacgagcccacacccatctcgtatttgattgccaaggcgcgcttgtcgtatgtattcggtcgcgtggttgaacaaagctcttctgtgtcgtccgtcccatacgaaaaagtaatggaactggacgcagaactccgacaggcaagggacttgatcccagagcacttacatattcggcctatggaggagtgccagttggatcctatcaatattatcatgtcgcggttttccgtaatggctgtatacgacaaagctcagtgtgtgcttcatcgcccgtatctggttcgcgcccgagaaaatcctcgtttcacctattctcggaggacatgtatcgactcagcaatggagttattgcgggtccaggcgcttctgcacgcggagacgcgcaacggacgcctccgcagtcgccagagccgagtaacttccctcacttcagcggactttttactagcaggcaccattgttactctcgacctataccacggcctgtcattgcaggtcagcggccggccatcaggagacacgtatacatggggccgagagcggcgcgatgaaatgaccgccgcgatccaacactcgaaagaaatttgggacgagtcgcgtgatgagagcatggaagcatggaaagcatccactgttctcggtgtgatgctcagcaagctacacatgacggtcccaggccttgagaatagcgccggagctgcttcatttgagccacaagacgagaagcagaacgcggccatgaccctcggcctactgagcagcggaatgagcccgatgaacccgggccagccgccgtttgctgatcccatgttcaagatgggagattcgccgatgggaactggaacaggtgctgtgggcgcctcggccgaaatgccgggtgctctttcgccctttagcagcatgttcgggcagatgccggacatgcaggttaaccttgattgggatgcctgggacacatacatccagaacccaaccctcgacacaacaaatcagttctggcctatgatggatgcacagcgccaggcaaccccacagtctggaggcatgtcacagccttcagtgtctagtcctctggcctcagggcgggtgccatcaattagtggtgttccacggataccgacaatgtactcagcatcctccaacagtcccgatagtgcaggtgtgccagtgacaggatacggcatgacgccaatgcctcaacaaaacgatggtcggggccaaggctcccaa

SEQ ID NO: 300 - protein, 859 aa, Penicillium chrysogenum
MIMPYPTKMTPTPPSTNSSSAGHSPDYRVVRKRNRVPLSCGPCRHRKLKCNRTHPCENCVKRGDAASCNYAQPNSRKKNPQQSSTTPDDMQNRIDRLEGLVLSLMTNGSQSAGPNAAMAAISGESSAGSTRFSHDLDAEEEGMEGAEESDTDQVTKSFGIMKMDNNKSYYISDAHWASVLSDIAEVKSFFSTHKKQMDAQIEKVKASQPPSEASGSTLLFGINKPMSRGEIMSGLPSKYTTDILIARYFNCYDPATHVLHGPTFQAQYNKHWDDPSATELVWIAMLFGMMRLAMLSYHREGDEPPEFRGKSLDMAGGFRNSVAQCLTLADYTKPHPFLIEALVFHLHGDFSLTREADISIWVMTGVVTRLAMRSGYHRDSKMYPNITPFQGEMRRRVWTFVRQADILFSYQVGLPGMIRGADSDTELPRNLYDDDFDEDCKELPPPRQLNEPTPISYLIAKARLSYVFGRVVEQSSSVSSVPYEKVMELDAELRQARDLIPEHLHIRPMEECQLDPINIIMSRFSVMAVYDKAQCVLHRPYLVRARENPRFTYSRRTCIDSAMELLRVQALLHAETRNGRLRSRQSRVTSLTSADFLLAGTIVTLDLYHGLSLQVSGRPSGDTYTWGRERRDEMTAAIQHSKEIWDESRDESMEAWKASTVLGVMLSKLHMTVPGLENSAGAASFEPQDEKQNAAMTLGLLSSGMSPMNPGQPPFADPMFKMGDSPMGTGTGAVGASAEMPGALSPFSSMFGQMPDMQVNLDWDAWDTYIQNPTLDTTNQFWPMMDAQRQATPQSGGMSQPSVSSPLASGRVPSISGVPRIPTMYSASSNSPDSAGVPVTGYGMTPMPQQNDGRGQGSQ

SEQ ID NO: 301 - DNA, 1272 bp, Aspergillus terreus
atggccaaacccaaccagcgccatgcctgtgaccgctgtcacggtcaaaaactgcgatgcatccactccgggggtgggccgtgtgtacgctgcgccaaagccaaagccacctgcagctggagccagtccttacgttccaaccgactcaagagacataacgcgccgatatctgatgttcctttggcgtgtgcgcaactagcaacccagtcgaccgacccaaacacacctcaatttggtgcatacatgagccaaccctcctccgccggcgttgacattgacatcaacttgctgcagactcaattcaccgacagtactccctgggctctgccggccggccgctatccctctccagcatcacaggaaatggagacttacaatgtgggtcacactgaggcggaccttccggccaccgcggactggatgtggcccgccgtcgccaatggtcccgttcaaacgactcccccggcaaattggcagcaagcattcaatcaggaatgggctatgatggcgtcgcagcaccctgtcgcaacgatggacacgccgtctcggacatcgccagtaagcgacgccgtggacccgccgaagacggtgtgccttcttgcgaccatccgcgagttgtcagagcttaacgtcgacctgtacgcacacgaagcgacggtccccagacctcctgcatctctggaggaaccgatcagctggaagaacaaggatttcgccatcgatcggactttccacctgtcccagcggctcattgagatcgtcaacaaacgatatccgcgctacctcgagacggcccgcatgcagaccccggaggggactcccgaacggacctccgaaagcagtctgtctggcccgccacttgaccaaggctcatgtctcctcgttctctcatgttacactcgactcatcgagacctacgatcgaatctttgccaatatgcagggatgtctggatcgttcctcggtcacggcccgagaagactacgtcaatatgccgtcggtccaagtcggctccttctccttgccacactcgtcctcgttgcaaatcgtcctcatcctgcagttggcgcgtcaactcctaactcgaatgggcgagatcatcaaagccgttcagccggagaaaagaactaaccccgctgatgtcaccttgtccgaatccgcaaccgggggtctcctactgtctagcgctttggagaccgtctccgccgaagaagaccgtctgatgaaaagaatcacgaaactacgaagcaccttgattgagctaaacattctg

SEQ ID NO: 302 - protein, 424 aa, Aspergillus terreus
MAKPNQRHACDRCHGQKLRCIHSGGGPCVRCAKAKATCSWSQSLRSNRLKRHNAPISDVPLACAQLATQSTDPNTPQFGAYMSQPSSAGVDIDINLLQTQFTDSTPWALPAGRYPSPASQEMETYNVGHTEADLPATADWMWPAVANGPVQTTPPANWQQAFNQEWAMMASQHPVATMDTPSRTSPVSDAVDPPKTVCLLATIRELSELNVDLYAHEATVPRPPASLEEPISWKNKDFAIDRTFHLSQRLIEIVNKRYPRYLETARMQTPEGTPERTSESSLSGPPLDQGSCLLVLSCYTRLIETYDRIFANMQGCLDRSSVTAREDYVNMPSVQVGSFSLPHSSSLQIVLILQLARQLLTRMGEIIKAVQPEKRTNPADVTLSESATGGLLLSSALETVSAEEDRLMKRITKLRSTLIELNIL

SEQ ID NO: 303 - DNA, 2550 bp, Aspergillus terreus
atgacaccgactcccccgtcaaccacctcgtccagcgccggtggaatctcaccggagggccattatcgagtcatccgaaagcgaaaccgggtgcctctatcctgcggcccctgccgacatagaaaactcaaatgcaaccgtgctcatccatgtgaaaactgcgtcaaacggggcgatgcctcgtcctgtacctatgcacaagccaacgcgcggaaaaagaactcaccgcttcagaccgcttcgagctcacccgacgacatgcaaaaccggatagatcgtcttgagagcttggtgctctctttgatgaccaatggatctcagtccgcaggccccacggcagctatggcggtcatttccggcaactccagcagcatcggctccgctcaacatacgtcggaagatgtagagctggacgatgatgatgggcaaggtcccgaggagagtgatacggagcaattgaccaagtcgatcggtatcatgaaggtcgacaacaacaaatcgtggtatatcagtgatgcacattgggcatcggtcctgagcgatatagcggaagtcaaaaattacttcaacacgcacaagaagcaatatgaagaacacgcagagaaaattaaagcgacgcgactcccaacagatgttcccggctcgaccttgctcttcggtgggacgaaaacgataagtcgcgaggaaatcatggcctctttcccatccaggtatactgcggatatcctcgttgcgcgctatttcaaccactatgacccttccacgcacattcttcatggccctacctttcaggcgcagtacaataaacactgggaggacccctccaaaacctgtattgtttggatcggtatgctttttgctatgatgcgactcgccatgctctcatatcatcgcgagggcgacgaacctccggagtttcgcgggaaggcgctggacatggcgggcacataccggaatctcatggcccagtgtttgacgttggccgactacaccaaaccgtacccttgtttgatcgaatctttagtcttccatctttacggcgacttctgtcagtcaaaggatgccgacgtgtctggatgggtgctggtgggcgtgattgcgagactggccatgaggatgggttaccaccgggattcgaagatgttccctaatatcaccccgttccaaggtgagatgcgacggcgggtgtgggcttttgtccggcaagcagacttgctcttttctgcccaagtcggcctgcccagcatgattcgcacttcggatagtgatacggagctaccacgcaatctctatgacgacgattttgacgagaattgcacggaactcccaccgtctcgaccatctaccgaaaccacgcccatctctttcttgatcgcgaaggcccgtatcacatatgctttcggccgcgttatagaagacacatcttctctccgaagcgctccatacgacaaggtcatggaaattgacgaggagcttcgtcgggcaagggatttggtaccagagcacttgagagttcgctctgtcgaagagacacaactggatcccgcgaaccttatcatgtctcggtttgagatcatgagtgtgtaccacaaagctcaatgcgttctccatcggcgattcctcgcccgggcgcgcgaaaaccctcgatttacctattctcgaagaacctgcattgattcggctctggagctactgcgatatcagtccatgattcataccgacacccgtcccaacggtcgtctgcgagggaagctcaaccggaccacgtccctctgttcgagcgactttctgcttgccgctaccattgtgtgcctagatctctatcatggacttcagctacaagctggaggtcgcgcttcagatgacacctacacctggggacgggagcgtcgcgacgaaatggttgcggctctacagcgctcgaaggagatctgggacgagcttcaagacgagaccatagacgcgtggaaggcttcaggagtcctcggcgtgatgcttgcccggctgaacctagacggcaacaccgcttcgaccacgttcgaaccgcaagacgagaagcagagtgccgcgatgacgttaggcctgcttagcagtggcatgaactatatgaatccaggaacacctggctttggagaagccacaaccaagatggcagatacaccagtgccgcccccgggcggctttggtgccgctgatatgcctggtgccccatcacccttcagcgccatgttcggacagatgccagatatgcaggtcaatttggattgggacgcttgggacaactacattcaaaactcctcgattgacttttccaatcagtggtggccggctatggacgcacagcaagcgccacagcctccgcaaccagggaacccgctttcgccatctcagttggctgcaacacagggcggaattgcaggaaggatgcgtacgatgccgtcgctttctagcgcattcccagaacccaatgggtacgatgcggctttccctacatccttcagcgtgaatgcgccgaaaaacccacacaatcctgcttcaggcccaggaaca

SEQ ID NO: 304 - protein, 850 aa, Aspergillus terreus
MTPTPPSTTSSSAGGISPEGHYRVIRKRNRVPLSCGPCRHRKLKCNRAHPCENCVKRGDASSCTYAQANARKKNSPLQTASSSPDDMQNRIDRLESLVLSLMTNGSQSAGPTAAMAVISGNSSSIGSAQHTSEDVELDDDDGQGPEESDTEQLTKSIGIMKVDNNKSWYISDAHWASVLSDIAEVKNYFNTHKKQYEEHAEKIKATRLPTDVPGSTLLFGGTKTISREEIMASFPSRYTADILVARYFNHYDPSTHILHGPTFQAQYNKHWEDPSKTCIVWIGMLFAMMRLAMLSYHREGDEPPEFRGKALDMAGTYRNLMAQCLTLADYTKPYPCLIESLVFHLYGDFCQSKDADVSGWVLVGVIARLAMRMGYHRDSKMFPNITPFQGEMRRRVWAFVRQADLLFSAQVGLPSMIRTSDSDTELPRNLYDDDFDENCTELPPSRPSTETTPISFLIAKARITYAFGRVIEDTSSLRSAPYDKVMEIDEELRRARDLVPEHLRVRSVEETQLDPANLIMSRFEIMSVYHKAQCVLHRRFLARARENPRFTYSRRTCIDSALELLRYQSMIHTDTRPNGRLRGKLNRTTSLCSSDFLLAATIVCLDLYHGLQLQAGGRASDDTYTWGRERRDEMVAALQRSKEIWDELQDETIDAWKASGVLGVMLARLNLDGNTASTTFEPQDEKQSAAMTLGLLSSGMNYMNPGTPGFGEATTKMADTPVPPPGGFGAADMPGAPSPFSAMFGQMPDMQVNLDWDAWDNYIQNSSIDFSNQWWPAMDAQQAPQPPQPGNPLSPSQLAATQGGIAGRMRTMPSLSSAFPEPNGYDAAFPTSFSVNAPKNPHNPASGPGT

SEQ ID NO: 305 - DNA, 2274 bp, Aspergillus nidulans
atgatctccgctccgggtcccgagcgacggcgcagacggccggcagtgtcatgttctctttgcagaaggcgtaagattaaatgcaaccgcgaaagcccctgtagcaactgcatcaagtctaaggcggaaccatgcgtctacgagagcgactcctcgtcccggccgcagcagcatcttggcttcaatcagacactggagctagggctctgcaaggcgtctgaacgccagatgctccctccagatgcggtaacttctcaagttcctagctatgcgtccaggtcattactctccagcgcgagagactcgtcatcccggacgagtcaagcttctgcatcggaggttgagtctctgaagaccaagatcagacagctggaggaacagctgtccagtgcgacgcagccggcggaatcacctccacggccgtctccaaactccagaatcgagaccagcacgtctcagatagcagggacgttccacataaaccatgaaaggcggcttctccacgattcccagttcgtcaaccgaaatctggtcatacataaaagtcgcctgtttggctccagtcattgggcacaggctgcatcgatgtttagagatgtatttgaaatgatcgaaccgtttatccgcgggagtggttccaaagccagtgccggcatcagaaggtgcaaagagctggcaaggattatcaaaacccaacggacgccgcaatggccgacgccgcccactcaggatctacctccaaaaggcgtcgctgatgagttggttgactgctatctccgtacaatcgagactacattccgggtcctgcacgtacctacattcaggtccgaatatgacgctctatgggtatctgaagcacggcccagcatcgcgttcacagtccaacttaagctggtgttggcactggggtctgtcacttacgacgagcggttttcaatgagacccagtgcggttcgttgggtatttgaggcgcacacctggctctctgatccagacttcaaacctcaacttaacatacagtgtttgcaaagcaggattctactattactagcccgcgagataatcaatgttggtggcgattcgagttggatatctgccggcggactactccgcactgctctacatatgggattacatagggatccgtctgtactgccgcctaggtcggcgctcgctgttgaaatgcgacgccgactgtggaacactatcctcgagctatcactgcagtcaagcatttcctccggtggacctccactaatttccctgggcgatttcgactgtgcgcctccagggaatttcgacgacgaacagctactggctgaggacccggtgccgaagagtgatgatgagtacactcaaacagcaatcgccagggcattgaggggaacctacccacagcgccttgcaattgtgaaattcctgaacgatctaagttcatatgggacttacgaggaaactcttcgacttgacgcagatttaagggaatcttacagggctatttgccgtatcctccgagggtatcccagcaacgggccttccccgtcacagttcgaaaaatgcatgctcgacttcatcatccacttctatgtgtgctgcctccatattccctacatcgagaagtcactgcgggcaccggcatatgcattctccaggaaagtcgcgatcgagagcgccctcaagatgtggtgcgccatttacccatcttccagattcatgagcaacacccgtcgcgagattagcggatccgttgaaaataagctgactcggttcgtggaatgcgggtttgggtttttccgcactggtgttataatcgcggccatgttcgtgaccttggagcttaaagctcagctcctggatgatgacagcctaggtcccagcccgtatcgggtagatcttttctctctgctctgtgaggcgaaagaccgttgttggaatatgattcaatgtggtgagactaatgtcaagggctacctcctcatttgtctggtaaccgcccagatcgaggggctgatgcatggagttgaaccgagcaaactccccgaactccttctccgcgcagcagaagaggcggaggaccggtgtcttgacttcatggaggagaaagccgatctgggacggagtggtggttccgttgaggtgatggacgaatctgcgaatacagcgcccttcatgggcgactgggagtttattatgacagatcctttccttaattatcctgggactactgaaccactcagctgggttatgaatgaagaaacgagaccattcataatg

SEQ ID NO: 306 - protein, 758 aa, Aspergillus nidulans
MISAPGPERRRRRPAVSCSLCRRRKIKCNRESPCSNCIKSKAEPCVYESDSSSRPQQHLGFNQTLELGLCKASERQMLPPDAVTSQVPSYASRSLLSSARDSSSRTSQASASEVESLKTKIRQLEEQLSSATQPAESPPRPSPNSRIETSTSQIAGTFHINHERRLLHDSQFVNRNLVIHKSRLFGSSHWAQAASMFRDVFEMIEPFIRGSGSKASAGIRRCKELARIIKTQRTPQWPTPPTQDLPPKGVADELVDCYLRTIETTFRVLHVPTFRSEYDALWVSEARPSIAFTVQLKLVLALGSVTYDERFSMRPSAVRWVFEAHTWLSDPDFKPQLNIQCLQSRILLLLAREIINVGGDSSWISAGGLLRTALHMGLHRDPSVLPPRSALAVEMRRRLWNTILELSLQSSISSGGPPLISLGDFDCAPPGNFDDEQLLAEDPVPKSDDEYTQTAIARALRGTYPQRLAIVKFLNDLSSYGTYEETLRLDADLRESYRAICRILRGYPSNGPSPSQFEKCMLDFIIHFYVCCLHIPYIEKSLRAPAYAFSRKVAIESALKMWCAIYPSSRFMSNTRREISGSVENKLTRFVECGFGFFRTGVIIAAMFVTLELKAQLLDDDSLGPSPYRVDLFSLLCEAKDRCWNMIQCGETNVKGYLLICLVTAQIEGLMHGVEPSKLPELLLRAAEEAEDRCLDFMEEKADLGRSGGSVEVMDESANTAPFMGDWEFIMTDPFLNYPGTTEPLSWVMNEETRPFIM

SEQ ID NO: 307 - DNA, 1728 bp, Aspergillus terreus
atgaacgatcctttcgtccccgccaaaaatcccggcccgacgaaagccgcgggtccctcgctgttggcctgtcttctgtgccgtcacaaacacctcaaatgtgatgggaaaactccagtgtgcggacgctgtgccgctactggatcggaatgccaatataccccgtcgcgtcgtgggtacaagggcccgtcgaagaagcgacgcgcaaacccgtcgtctccagagcaaacgcccgccgatctggccgcctcgttcgatccgcagtccatcggtttggtcaatgtcacccctgactggagcctgcaaaacacggtccctttcatgcccgtcgctaccttcccgtcctcctcgtcgaccagcccgggcttgaccgactacaccaattcttcgcaacccatccggttcacgaatgaccccctaactcccgactcttccgcctcggtccccggtgatgggtatttgatcgatatctactatacctatttccatccctcgcacccaattctccctccgctccgctttctctaccgctcctatctcccgaccttcctggagcaggtcatcaagttcatcggtgctcatttcactccggccgcttcgagcgagacgtatcgacccaccgttgtgtcaaatgtgaaggagcaagagggctctatagagaagctgcaggctctcttgttgctcgcggtggtcctccactctcgcaatgaacgtcccgaagctggcgagtgtctcgccggagctgttgacctagcgtttgagctgggactccagacgcagagtttcgccaccgcgatgagcgacggtgaccccatccgcgcggaatgcctgcggcgcacatggtgggagctgttcattatcgaggggatgctgactgcacttggggttcagagcacttaccgtaccaacatggtgccgccggaggtgggactaccatgtgaggaacggatctaccaggatggcctggcgccgcccccgcctccaacgatcgctcaattcgacaatcgcgtcttcgccgacgaggagcgcgacttctcttccttcacctaccgtatcgaggcggtccgcattctcgggcgcgtggtcggcatccaggacatggtcgagggccaacaggaccatgtggaggccattgacgcccgaatcacgagttggttccaccacctccccgagtccaaggcggagctgctgcgtcccgatggttccgtggatgagatgatgttccaagccaccatgatcgtgaacggcgcgtcgatatacctccacttcccccgttctgatttgctgtcatcgcccgccatggccgcggaagtgatctgcggtcaccacggaccctgcagcattcccgcattttcacaccacgcccatgcaatgaaggccctcaaagccgccagcgagatctcctcgctggcttccatccgcatgccggtggtcaaacacacgcccttcttcatctgcgccctggttatgagctcgatcgtgcagctggctgcatgctccgtcaaggccgggcagatgcccgatcccagccgggatcgcctcaccctgaccattggcgtcttcaaatccctggcccgcacgtgggccatctcccagacaatcatgaggcagatcaaagccgtgtcgcgcgatgttatggacatgggactgcggccggccatggaccagattgatctgacgaccctcctcgatagcggtcggttcttgatgcccgatggactgatgcga

SEQ ID NO: 308 - protein, 576 aa, Aspergillus terreus
MNDPFVPAKNPGPTKAAGPSLLACLLCRHKHLKCDGKTPVCGRCAATGSECQYTPSRRGYKGPSKKRRANPSSPEQTPADLAASFDPQSIGLVNVTPDWSLQNTVPFMPVATFPSSSSTSPGLTDYTNSSQPIRFTNDPLTPDSSASVPGDGYLIDIYYTYFHPSHPILPPLRFLYRSYLPTFLEQVIKFIGAHFTPAASSETYRPTVVSNVKEQEGSIEKLQALLLLAVVLHSRNERPEAGECLAGAVDLAFELGLQTQSFATAMSDGDPIRAECLRRTWWELFIIEGMLTALGVQSTYRTNMVPPEVGLPCEERIYQDGLAPPPPPTIAQFDNRVFADEERDFSSFTYRIEAVRILGRVVGIQDMVEGQQDHVEAIDARITSWFHHLPESKAELLRPDGSVDEMMFQATMIVNGASIYLHFPRSDLLSSPAMAAEVICGHHGPCSIPAFSHHAHAMKALKAASEISSLASIRMPVVKHTPFFICALVMSSIVQLAACSVKAGQMPDPSRDRLTLTIGVFKSLARTWAISQTIMRQIKAVSRDVMDMGLRPAMDQIDLTTLLDSGRFLMPDGLMR

What is claimed is:

1. A method for improving the production of a secondary metabolite by a fungus by increasing the yield or productivity of the secondary metabolite produced by the fungus, the method comprising:
increasing the expression of a gene encoding a protein comprising the amino acid sequence encoded by SEQ ID NO:157 in a manner that improves the yield or productivity of the secondary metabolite.

2. The method of claim 1, wherein the step of increasing the expression of a gene encoding a protein comprising the amino acid sequence encoded by SEQ ID NO:157 comprises transforming the fungus with a nucleic acid molecule encoding a polypeptide encoded by SEQ ID NO:157.

3. The method of claim 2 wherein the nucleic acid molecule comprises SEQ ID NO:157.

4. The method of claim 1, wherein the secondary metabolite is an antibacterial.

5. The method of claim 4, wherein the antibacterial is a β-lactam.

6. The method of claim 5, wherein the β-lactam is selected from the group consisting of: penicillins and cephalosporins.

7. The method of claim 6, wherein the penicillin is selected from the group consisting of: isopenicillin N, 6-aminopenicillanic acid (6-APA), penicillin G, penicillin N, and penicillin V.

8. The method of claim 6, wherein the cephalosporin is selected from the group consisting of: deacetoxycephalosporin V (DAOC V), deacetoxycephalosporin C (DAOC), deacetylcephalosporin C (DAC), 7-aminodeacetoxycephalosporanic acid (7-ADCA), cephalosporin C, 7-β-(5-carboxy-5-oxopentanamido)-cephalosporanic acid (keto-AD-7ACA), 7-β-(4-carboxybutanamido)-cephalosporanic acid (GL-7ACA), and 7-aminocephalosporanic acid (7ACA).

9. The method of claim 1, wherein the secondary metabolite is an antihypercholesterolemic.

10. The method of claim 9, wherein the anti-hypercholesterolemic is selected from the group consisting of: lovastatin, mevastatin, simvastatin, and pravastatin.

11. The method of claim 1, wherein the secondary metabolite is an immunosuppressant.

12. The method of claim 11, wherein the immunosuppressant is selected from the group consisting of: members of the cyclosporin family and beauverolide L.

13. The method of claim 12, wherein the member of the cyclosporin family is selected from the group consisting of: cyclosporin A and cyclosporin C.

14. The method of claim 1, wherein the secondary metabolite is an ergot alkaloid.

15. The method of claim 14, wherein the ergot alkaloid is selected from the group consisting of: clavine alkaloids, lysergic acids, lysergic acid amides, ergot peptide alkaloids, ergotamine, ergosine, ergocristine, ergocryptine, ergocornine, ergotaminine, ergosinine, ergocristinine, ergocryptinine, ergocominine, ergonovine, ergometrinine, and ergoclavine.

16. The method of claim 1, wherein the secondary metabolite is an inhibitor of angiogenesis.

17. The method of claim 16, wherein the inhibitor of angiogenesis is selected from the group consisting of: fumagillin and ovalicin.

18. The method of claim 17, wherein the secondary metabolite is a glucan synthase inhibitor.

19. The method of claim 18, wherein the glucan synthase inhibitor is selected from the group consisting of: echinocandin B, pneumocandin B, aculeacin A, and papulacandin.

20. The method of claim 1, wherein the secondary metabolite is a member of the gliotoxin family of compounds.

21. The method of claim 20, wherein the member of the gliotoxin family of compounds is selected from gliotoxin and aspirochlorine.

22. The method of claim 1, wherein the secondary metabolite is a fungal toxin.

23. The method of claim 22, wherein the fungal toxin is selected from the group consisting of: aflatoxins, patulin, zearalenone, cytochalasin, griseofulvin, ergochrome, cercosporin, marticin, xanthocillin, coumarins, tricothecenes, fusidanes, sesterpenes, amatoxins, malformin A, phallotoxins, pentoxin, HC toxin, psilocybin, bufotenine, lysergic acid, sporodesmin, puicheriminic acid, sordarins, fumonisins, ochratoxin A, and fusaric acid.

24. The method of claim 1, wherein the secondary metabolite is a modulator of cell surface receptor signaling.

25. The method of claim 24, wherein the modulator of cell surface receptor signaling is selected from the group consisting of the insulin receptor agonist L-783,281 and the cholecystokinin receptor antagonist asperlicin.

26. The method of claim 1, wherein the secondary metabolite is a plant growth regulator.

27. The method of claim 26, wherein the plant growth regulator is selected from the group consisting of: cytokinin, auxin, gibberellin, abscisic acid, and ethylene.

28. The method of claim 1, wherein the secondary metabolite is a pigment.

29. The method of claim 28, wherein the pigment is selected from the group consisting of: melanins and carotenoids.

30. The method of claim 1, wherein the secondary metabolite is an insecticide.

31. The method of claim 30, wherein the insecticide is nodulisporic acid.

32. The method of claim 1, wherein the secondary metabolite is an anti-neoplastic compound.

33. The method of claim 32, wherein the antineoplastic compound is selected from the group consisting of: taxol (paclitaxel) and related taxoids.

34. A method for producing a secondary metabolite, the method comprising:

a) providing a fungal cell transformed with a nucleic acid molecule encoding a protein comprising the amino acid sequence encoded by SEQ ID NO:157;

b) culturing the fungal cell under conditions suitable for production of the secondary metabolite; and c) isolating a fraction containing the secondary metabolite from the medium in which the fungal cell has been cultured or from the fungal cell.

35. The method of claim 1 or claim 34 wherein the secondary metabolite is a polyketide.

36. The method of claim 35 wherein the polyketide is a statin.

37. The method of claim 36 wherein the statin is selected from the group consisting of: lovastatin, mevastatin, simvastatin and pravastatin.

38. The method of claim 37 wherein the fungus is *A. terreus*.

39. The method of claim 1 or claim 34 wherein the fungal cell is a *Penicillium* cell.

40. The method of claim 1 or claim 34 wherein the fungal cell is an *Aspergillus* cell.

41. The method of claim 40 wherein the fungal cell is an *A. terreus* cell.

42. The method of claim 34, wherein the nucleic acid molecule comprises SEQ ID NO:157.

* * * * *

UNITED STATES PATENT AND TRADEMARK OFFICE
CERTIFICATE OF CORRECTION

| | | |
|---|---|---|
| PATENT NO. | : 7,229,784 B2 | Page 1 of 1 |
| APPLICATION NO. | : 10/149310 | |
| DATED | : June 12, 2007 | |
| INVENTOR(S) | : Douglas Holtzman et al. | |

It is certified that error appears in the above-identified patent and that said Letters Patent is hereby corrected as shown below:

Column 27, line 1: delete "puicheriminic" and replace with --pulcheriminic--.

Signed and Sealed this

Twenty-ninth Day of July, 2008

JON W. DUDAS
*Director of the United States Patent and Trademark Office*